(12) United States Patent
Sissons et al.

(10) Patent No.: US 11,072,660 B2
(45) Date of Patent: Jul. 27, 2021

(54) HPV-SPECIFIC BINDING MOLECULES

(71) Applicant: Juno Therapeutics, Inc., Seattle, WA (US)

(72) Inventors: James Sissons, Seattle, WA (US); Cameron Brandt, Seattle, WA (US); Alexandra Croft, Seattle, WA (US); Allen Ebens, Seattle, WA (US); Haley Peper, Seattle, WA (US); Dean Y. Toy, Seattle, WA (US)

(73) Assignee: Juno Therapeutics, Inc., Seattle, WA (US)

( * ) Notice: Subject to any disclaimer, the term of this patent is extended or adjusted under 35 U.S.C. 154(b) by 0 days.

(21) Appl. No.: 16/338,452

(22) PCT Filed: Oct. 3, 2017

(86) PCT No.: PCT/US2017/055005
§ 371 (c)(1),
(2) Date: Mar. 29, 2019

(87) PCT Pub. No.: WO2018/067618
PCT Pub. Date: Apr. 12, 2018

(65) Prior Publication Data
US 2019/0225692 A1    Jul. 25, 2019

Related U.S. Application Data

(60) Provisional application No. 62/403,661, filed on Oct. 3, 2016.

(51) Int. Cl.
| | | |
|---|---|---|
| *C07K 14/705* | (2006.01) | |
| *C07K 16/28* | (2006.01) | |
| *C07K 14/725* | (2006.01) | |
| *C07K 16/08* | (2006.01) | |
| *A61P 31/20* | (2006.01) | |
| *A61K 39/12* | (2006.01) | |
| *A61K 39/00* | (2006.01) | |

(52) U.S. Cl.
CPC .......... *C07K 16/2833* (2013.01); *A61K 39/12* (2013.01); *A61P 31/20* (2018.01); *C07K 14/7051* (2013.01); *C07K 16/084* (2013.01); *A61K 2039/5156* (2013.01); *A61K 2039/572* (2013.01); *A61K 2039/585* (2013.01); *C07K 2317/21* (2013.01); *C07K 2317/24* (2013.01); *C07K 2317/32* (2013.01); *C07K 2317/34* (2013.01); *C07K 2317/622* (2013.01); *C07K 2317/624* (2013.01); *C07K 2319/02* (2013.01)

(58) Field of Classification Search
None
See application file for complete search history.

(56) References Cited

U.S. PATENT DOCUMENTS

| | | |
|---|---|---|
| 4,235,871 A | 11/1980 | Papahadjopoulos et al. |
| 4,452,773 A | 6/1984 | Molday et al. |
| 4,501,728 A | 2/1985 | Geho et al. |
| 4,690,915 A | 9/1987 | Rosenberg et al. |
| 4,777,239 A | 10/1988 | Schoolnik et al. |
| 4,795,698 A | 1/1989 | Owen et al. |
| 4,837,028 A | 6/1989 | Allen et al. |
| 5,019,369 A | 5/1991 | Presant et al. |
| 5,087,616 A | 2/1992 | Myers et al. |
| 5,200,084 A | 4/1993 | Liberti et al. |
| 5,219,740 A | 6/1993 | Miller et al. |
| 5,283,173 A | 2/1994 | Fields et al. |
| 5,468,614 A | 11/1995 | Fields et al. |
| 5,789,538 A | 8/1998 | Rebar et al. |
| 6,007,988 A | 12/1999 | Choo et al. |
| 6,013,453 A | 1/2000 | Choo et al. |
| 6,040,177 A | 3/2000 | Riddell et al. |
| 6,060,273 A | 5/2000 | Dirks et al. |
| 6,140,081 A | 10/2000 | Barbas et al. |
| 6,183,746 B1 | 2/2001 | Urban et al. |
| 6,207,453 B1 | 3/2001 | Maass et al. |
| 6,355,424 B1 | 3/2002 | Lorincz et al. |
| 6,410,319 B1 | 6/2002 | Raubitschek et al. |
| 6,451,995 B1 | 9/2002 | Cheung et al. |
| 6,453,242 B1 | 9/2002 | Eisenberg et al. |
| 6,534,261 B1 | 3/2003 | Cox et al. |
| 6,582,704 B2 | 6/2003 | Urban et al. |
| 6,602,684 B1 | 8/2003 | Umana et al. |
| 7,070,995 B2 | 7/2006 | Jensen et al. |

(Continued)

FOREIGN PATENT DOCUMENTS

| | | |
|---|---|---|
| AU | 2004/308964 | 7/2005 |
| CA | 2551560 | 7/2005 |

(Continued)

OTHER PUBLICATIONS

US 8,252,592 B2, 08/2012, Sadelain et al. (withdrawn)
Draper et al. Targeting of HPV-16þ Epithelial Cancer Cells by TCR Gene Engineered T Cells Directed against E6. Clin Cancer Res; 21(19); 4431-9.*
Garcillian. "List of Jurkat derived cells lines deficient in some TCR subunits" (2015) Retrieved from https://www. researchg ate. net/ post/ Are_there_any _human_ T _ce l l_li nes_defective_for _both_ the_al pha_and_beta_ TCR_su bun its/ 54c2262fd5a3f2fd0e8b4635/ citation/download. Retrieved on Jun. 23, 2020.

(Continued)

*Primary Examiner* — Nianxiang Zou
(74) *Attorney, Agent, or Firm* — Morrison & Foerster LLP

(57) ABSTRACT

Provided are binding molecules, such as TCRs or antigen binding fragments thereof and antibodies and antigen-binding fragments thereof, such as those that recognize or bind human papilloma virus (HPV) 16, including HPV 16 E6 and HPV 16 E7. Also provided are engineered cells containing such binding molecules, compositions containing the binding molecules or engineered cells, and methods of treatment, such as administration of the binding molecules, engineered cells, or compositions.

34 Claims, 31 Drawing Sheets

Specification includes a Sequence Listing.

(56) References Cited

U.S. PATENT DOCUMENTS

| | | |
|---|---|---|
| 7,097,843 B2 | 8/2006 | Urban et al. |
| 7,189,513 B2 | 3/2007 | Khleif et al. |
| 7,265,209 B2 | 9/2007 | Jensen et al. |
| 7,354,762 B2 | 4/2008 | Jensen et al. |
| 7,399,467 B2 | 7/2008 | Lu et al. |
| 7,446,179 B2 | 11/2008 | Jensen et al. |
| 7,446,190 B2 | 11/2008 | Jensen et al. |
| 7,446,191 B2 | 11/2008 | Jensen et al. |
| 7,507,538 B2 | 3/2009 | Khleif et al. |
| 7,521,541 B2 | 4/2009 | Eigenbrot et al. |
| 7,569,664 B2 | 8/2009 | Jakobsen et al. |
| 7,855,275 B2 | 12/2010 | Eigenbrot et al. |
| 8,252,893 B2 | 8/2012 | Kim et al. |
| 8,324,353 B2 | 12/2012 | Jensen et al. |
| 8,389,282 B2 | 3/2013 | Sadelain et al. |
| 8,399,645 B2 | 3/2013 | Campana et al. |
| 8,497,118 B2 | 7/2013 | Jensen |
| 8,802,374 B2 | 8/2014 | Jensen et al. |
| 8,865,162 B2 | 10/2014 | Cheng et al. |
| 8,911,993 B2 | 12/2014 | June et al. |
| 8,956,828 B2 | 2/2015 | Bonini et al. |
| 8,968,995 B2 | 3/2015 | Cheng et al. |
| 9,273,283 B2 | 3/2016 | Sentman et al. |
| 2002/0131960 A1 | 9/2002 | Sadelain et al. |
| 2002/0164328 A1 | 11/2002 | Shinkawa et al. |
| 2003/0115614 A1 | 6/2003 | Kanda et al. |
| 2003/0157108 A1 | 8/2003 | Presta et al. |
| 2003/0170238 A1 | 9/2003 | Gruenberg et al. |
| 2004/0093621 A1 | 5/2004 | Shitara et al. |
| 2004/0109865 A1 | 6/2004 | Niwa et al. |
| 2004/0110282 A1 | 6/2004 | Kanda et al. |
| 2004/0110704 A1 | 6/2004 | Yamane et al. |
| 2004/0132140 A1 | 7/2004 | Satoh et al. |
| 2005/0123546 A1 | 6/2005 | Umana et al. |
| 2007/0116690 A1 | 5/2007 | Yang et al. |
| 2009/0047660 A1 | 2/2009 | Lu et al. |
| 2009/0117140 A1 | 5/2009 | Nakagawa et al. |
| 2010/0047805 A1 | 2/2010 | Wang et al. |
| 2010/0209904 A1 | 8/2010 | Lu et al. |
| 2011/0003380 A1 | 1/2011 | Miltenyi et al. |
| 2011/0158957 A1 | 6/2011 | Bonini et al. |
| 2011/0207221 A1 | 8/2011 | Cost et al. |
| 2011/0301073 A1 | 12/2011 | Gregory et al. |
| 2012/0164629 A1 | 6/2012 | Lu et al. |
| 2013/0149337 A1 | 6/2013 | Cooper et al. |
| 2013/0287748 A1 | 10/2013 | June et al. |
| 2014/0219975 A1 | 8/2014 | June et al. |
| 2014/0301990 A1 | 10/2014 | Gregory et al. |
| 2015/0056705 A1 | 2/2015 | Conway et al. |
| 2015/0093742 A1 | 4/2015 | Lu et al. |
| 2015/0098954 A1 | 4/2015 | Hyde et al. |
| 2015/0164954 A1 | 6/2015 | Bonini et al. |
| 2015/0203817 A1 | 7/2015 | Galetto et al. |
| 2016/0208243 A1 | 7/2016 | Zhang et al. |
| 2016/0272999 A1 | 9/2016 | Duchateau et al. |
| 2017/0016025 A1 | 1/2017 | Poirot et al. |
| 2017/0016027 A1 | 1/2017 | Lee et al. |
| 2017/0088895 A1 | 3/2017 | Han et al. |
| 2017/0145070 A1* | 5/2017 | Hinrichs .................. A61P 15/00 |
| 2017/0211075 A1 | 7/2017 | Lee et al. |
| 2017/0290858 A1* | 10/2017 | Zhao ....................... A61P 37/06 |
| 2019/0321401 A1 | 10/2019 | Goldfless |

FOREIGN PATENT DOCUMENTS

| | | |
|---|---|---|
| EP | 452342 | 10/1991 |
| EP | 1708745 | 4/2012 |
| EP | 2537416 | 12/2012 |
| JP | 2007-522108 | 8/2007 |
| WO | WO 1992/008796 | 5/1992 |
| WO | WO 1994/028143 | 12/1994 |
| WO | WO 1995/019431 | 7/1995 |
| WO | WO 1996/006166 | 2/1996 |
| WO | WO 1996/013593 | 5/1996 |
| WO | WO 1996/018105 | 6/1996 |
| WO | WO 1997/030087 | 8/1997 |
| WO | WO 1998/054311 | 3/1998 |
| WO | WO 1998/053057 | 11/1998 |
| WO | WO 1998/053058 | 11/1998 |
| WO | WO 1998/053059 | 11/1998 |
| WO | WO 1998/053060 | 11/1998 |
| WO | WO 1998/058964 | 12/1998 |
| WO | WO 1999/018129 | 4/1999 |
| WO | WO 1999/022764 | 5/1999 |
| WO | WO 1999/060120 | 11/1999 |
| WO | WO 2000/014257 | 3/2000 |
| WO | WO 2000/061739 | 10/2000 |
| WO | WO 2000/067761 | 11/2000 |
| WO | WO 2001/029246 | 4/2001 |
| WO | WO 2001/060970 | 8/2001 |
| WO | WO 2002/016536 | 2/2002 |
| WO | WO 2002/031140 | 4/2002 |
| WO | WO 2002/077012 | 10/2002 |
| WO | WO 2003/011878 | 2/2003 |
| WO | WO 2003/016496 | 2/2003 |
| WO | WO 2003/020763 | 3/2003 |
| WO | WO 2003/084570 | 10/2003 |
| WO | WO 2003/085107 | 10/2003 |
| WO | WO 2003/085119 | 10/2003 |
| WO | WO 2004/033685 | 4/2004 |
| WO | WO 2004/056312 | 7/2004 |
| WO | WO 2005/035586 | 4/2005 |
| WO | WO 2005/035778 | 4/2005 |
| WO | WO 2005/053742 | 6/2005 |
| WO | WO 2006/000830 | 1/2006 |
| WO | WO 2006/037960 | 4/2006 |
| WO | WO 2006/059529 | 6/2006 |
| WO | WO 2008/121420 | 10/2008 |
| WO | WO 2008/147187 | 12/2008 |
| WO | WO 2009/120022 | 1/2009 |
| WO | WO 2009/072003 | 6/2009 |
| WO | WO 2009/148229 | 12/2009 |
| WO | WO 2009/148230 | 12/2009 |
| WO | WO 2010/033140 | 3/2010 |
| WO | WO 2010/123561 | 10/2010 |
| WO | WO 2011/044186 | 4/2011 |
| WO | WO 2011/101122 | 8/2011 |
| WO | WO 2012/048340 | 4/2012 |
| WO | WO 2012/048341 | 4/2012 |
| WO | WO 2012/036437 | 6/2012 |
| WO | WO 2012/129514 | 9/2012 |
| WO | WO 2013/037695 | 3/2013 |
| WO | WO 2013/071154 | 5/2013 |
| WO | WO 2013/123061 | 8/2013 |
| WO | WO 2013/126726 | 8/2013 |
| WO | WO 2013/166321 | 11/2013 |
| WO | WO 2013/169386 | 11/2013 |
| WO | WO 2014/031687 | 2/2014 |
| WO | WO 2014/055668 | 4/2014 |
| WO | WO 2014/096803 | 6/2014 |
| WO | WO 2014/134165 | 9/2014 |
| WO | WO 2014/191128 | 12/2014 |
| WO | WO 2015/009604 | 1/2015 |
| WO | WO 2015/009606 | 1/2015 |
| WO | WO 2015/010347 | 1/2015 |
| WO | WO-2015009606 A1 * | 1/2015 ............ A61P 35/00 |
| WO | WO 2015/018943 | 2/2015 |
| WO | WO 2015/066551 | 5/2015 |
| WO | WO 2015/136001 | 9/2015 |
| WO | WO 2015/143558 | 10/2015 |
| WO | WO 2015/161276 | 10/2015 |
| WO | WO 2015/184228 | 12/2015 |
| WO | WO 2016/016341 | 2/2016 |
| WO | WO 2016/044227 | 3/2016 |
| WO | WO 2016/069282 | 5/2016 |
| WO | WO 2016/069283 | 5/2016 |
| WO | WO 2016/146618 | 9/2016 |
| WO | WO 2017/070429 | 4/2017 |
| WO | WO 2017/093969 | 6/2017 |

(56) References Cited

FOREIGN PATENT DOCUMENTS

| WO | WO 2019/070541 | 4/2019 |
|---|---|---|
| WO | WO2019195486 A1 | 10/2019 |

OTHER PUBLICATIONS

U.S. Appl. No. 16/374,729, filed Apr. 3, 2019, by Goldfless et al.
Alonso-Camino et al., "CARbodies: Human Antibodies Against Cell Surface Tumor Antigens Selected From Repertoires Displayed on T Cell Chimeric Antigen Receptors," Mol Ther Nucl Acids (2013) 2(5): e93.
Bae et al., "Cas-OFFinder: a fast and versatile algorithm that searches for potential off-target sites of Cas9 RNA-guided endonucleases," Bioinformatics (2014) 30(10):1473-5.
Banu et al., "Building and Optimizing a Virus-specific T Cell Receptor Library for Targeted Immunotherapy in Viral Infections." Sci Rep. Feb. 25, 2014;4:4166.
Boris-Lawrie et al., "Recent advances in retrovirus vector technology," Cur. Opin. Genet. Develop. (1993) 3:102-109.
Brash et al., "Strontium phosphate transfection of human cells in primary culture: stable expression of the simian virus 40 large-T-antigen gene in primary human bronchial epithelial cells," Mol. Cell Biol., (1987) 7: 2031-2034.
Burns et al., "Vesicular stomatitis virus G glycoprotein pseudotyped retroviral vectors: concentration to very high titer and efficient gene transfer into mammalian and nonmammalian cells," Proc. Natl. Acad. Sci. USA, (1993) 90:8033-8037.
Cameron et al., "Identification of a Titin-derived HLA-A1-presented peptide as a cross-reactive target for engineered MAGE A3-directed T cells." Sci Transl Med. Aug. 7, 2013;5(197):197ra103.
Carlens et al., "Ex vivo T lymphocyte expansion for retroviral transduction: influence of serum-free media on variations in cell expansion rates and lymphocyte subset distribution," Exp Hematol., (2000) 28(10):1137-46.
Cavalieri et al., "Human T lymphocytes transduced by lentiviral vectors in the absence of TCR activation maintain an intact immune competence," Blood, (2003) 102(2):497-505.
Cheever et al., "The prioritization of cancer antigens: a national cancer institute pilot project for the acceleration of translational research." Clin Cancer Res. Sep. 1, 2009;15(17):5323-37.
Chervin et al., "Engineering higher affinity T cell receptors using a T cell display system," J Immunol Methods, (2008) 339(2):175-84.
Chicaybam et al, "An Efficient Low Cost Method for Gene Transfer to T Lymphocytes," PLoS ONE, (2013) 8(3): e60298.
Cho et al., "Human mammalian cell sorting using a highly integrated micro-fabricated fluorescence-activated cell sorter (ξFACS)," Lab Chip, (2010) 10(12):1567-1573.
Chothia et al., "The outline structure of the T-cell alpha beta receptor," EMBO J., (1988) 7(12):3745-3755.
Chowdhury, "Engineering hot spots for affinity enhancement of antibodies," Methods Mol. Biol. 207:179-196 (2008).
Clackson et al., "Making antibody fragments using phage display libraries," Nature, (1991) 352(6336):624-628.
Clinical Trial Study Record No. NCT02280811. Updated Sep. 6, 2017. Accessed Mar. 28, 2019.
Clinical Trial Study Record No. NCT02379520. Updated Dec. 13, 2019. Accessed Mar. 28, 2019.
Clinical Trial Study Record No. NCT02858310. Updated Mar. 18, 2019. Accessed Mar. 28, 2019.
Clinical Trial Study Record No. NCT01462838. Updated Jun. 23, 2015. Accessed Jun. 20, 2019.
Clinical Trial Study Record No. NCT02291055. Updated in Mar. 14, 2018. Accessed Jun. 20, 2019.
Clinical Trial Study Record No. NCT02426892. Updated in May 10, 2019. Accessed Jun. 20, 2019.
Clinical Trial Study Record No. NCT02526316. Updated in Jul. 2, 2017. Accessed Jun. 20, 2019.
Clinical Trial Study Record No. NCT03260023. Updated in Mar. 21, 2019. Accessed Jun. 20, 2019.
Clinical Trial Study Record No. NCT03439085. Updated in May 29, 2019. Accessed Jun. 20, 2019.
Cooper et al., "T-cell clones can be rendered specific for CD19: toward the selective augmentation of the graft-versus-B-lineage leukemia effect," Blood, (2003) 101:1637-1644.
Daniel-Meshulam et al., "How (specific) would like your T-cells today? Generating T-cell therapeutic function through TCR-gene transfer." Front Immunol. Jul. 6, 2012;3:186.
Davila et al., "CD19 CAR-Targeted T Cells Induce Long-Term Remission and B Cell Aplasia in an Immunocompetent Mouse Model of B Cell Acute Lymphoblastic Leukemia," PLoS ONE, (2013) 8(4): e61338.
De Castro et al., "ScanProsite: detection of PROSITE signature matches and ProRule-associated functional and structural residues in proteins.," Nucleic Acids Res. (2006); 34(Web Server issue):W362-5.
De Felipe et al., "Targeting of proteins derived from self-processing polyproteins containing multiple signal sequences," Traffic, (2004) 5(8):616-626.
De Felipe, "Skipping the co-expression problem: the new 2A "CHYSEL" technology," Genetic Vaccines and Ther., (2004) 2:13.
Draper et al., "Targeting of HPV-16+ Epithelial Cancer Cells by TCR Gene Engineered T Cells Directed against E6," Clinical Cancer Research, (2015) 21(19):4431-4439.
Ehrenmann et al., "IMGT/3Dstructure-DB and IMGT/DomainGapAlign: a database and a tool for immunoglobulins or antibodies, T cell receptors, MHC, IgSF and MhcSF." Nucleic Acids Res. Jan. 2010;38(Database issue):D301-7.
Endo et al., "High-throughput, genome-scale protein production method based on the wheat germ cell-free expression system," Biotechnol. Adv., (2003) 21:695-713.
Fedorov et al., "PD-1- and CTLA-4-based inhibitory chimeric antigen receptors (iCARs) divert off-target immunotherapy responses," Sci. Transl. Medicine, (2013) 5(215):215RA172.
Flatman et al., "Process analytics for purification of monoclonal antibodies," J. Chromatogr. B, (2007) 848(1):79-87.
Fu et al., "Improving CRISPR-Cas nuclease specificity using truncated guide RNAs," Nat Biotechnol, (2014) 32(3):279-284.
Gerngross, "Advances in the production of human therapeutic proteins in yeasts and filamentous fungi," Nat. Biotech., (2004) 22(11):1409-1414.
Godin et al., "Microfluidics and photonics for Bio-System-on-a-Chip: a review of advancements in technology towards a microfluidic flow cytometry chip," J Biophoton., (2008) 1(5):355-376.
Haga-Friedman et al., "Incorporation of transmembrane hydrophobic mutations in the TCR enhance its surface expression and T cell functional avidity," Journal of Immunology, (2012) 188:5538-5546.
Heigwer et al., "E-CRISP: fast CRISPR target site identification," Nat Methods, (2014) 11(2):122-3.
Hermans et al., "The VITAL assay: a versatile fluorometric technique for assessing CTL- and NKT-mediated cytotoxicity against multiple targets in vitro and in vivo," J. Immunological Methods, 285(1): 25-40 (2004).
Ho et al., "Cytolytic CD8+ T cells directed against a cryptic epitope derived from a retroviral alternative reading frame confer disease protection." J Immunol. Feb. 15, 2006;176(4):2470-5.
Ho et al., "In vitro methods for generating CD8+ T-cell clones for immunotherapy from the naive repertoire," J. Immunol. Methods, (2006) 310(1-2):40-52.
Holler et al., "In vitro evolution of a T cell receptor with high affinity for peptide/MHC," Proc Natl Acad Sci USA, (2000) 97(10):5387-92.
Holler et al., "TCRs with high affinity for foreign pMHC show self-reactivity," Nat Immunol, (2003) 4(1):55-62.
Hsu et al., "DNA targeting specificity of RNA-guided Cas9 nucleases," Nat Biotechnol, (2013) 31(9):827-32.
Hudecek et al., "Receptor Affinity and Extracellular Domain Modifications Affect Tumor Recognition by ROR1-Specific Chimeric Antigen Receptor T Cells," Clin. Cancer Res., (2013) 19(12):3153-3164.
Johnston, "Biolistic transformation: microbes to mice," Nature, (1990) 346: 776-777.

(56) References Cited

OTHER PUBLICATIONS

Jones et al., "Distinct CDR3 conformations in TCRs determine the level of cross-reactivity for diverse antigens, but not the docking orientation." J Immunol. Nov. 1, 2008;181(9):6255-64.
Jores et al., "Resolution of hypervariable regions in T-cell receptor beta chains by a modified Wu-Kabat index of amino acid diversity," Proc. Nat'l Acad. Sci. USA, (1990) 87(23):9138-42.
Joyce et al., "T Cell Exclusion, Immune Privilege, and the Tumor Microenvironment." Science Apr. 3, 2015;342(6230);74-80.
Kanda et al., "Comparison of cell lines for stable production of fucose-negative antibodies with enhanced ADCC," Biotechnol. Bioeng., (2006) 94(4):680-688.
Kerry et al., "Interplay between TCR Affinity and Necessity of Coreceptor Ligation: High-Affinity Peptide-MHC/TCR Interaction Overcomes Lack of CD8 Engagement," J. Immunology, (2003) 171(9): 4493-4503.
Kerry et al., "Memory CD8+ T cells require CD8 coreceptor engagement for calcium mobilization and proliferation, but not cytokine production," Immunology (2005) 114(1):44-52.
Kessels et al., "Generation of T cell help through a MHC class I-restricted TCR." J Immunol. Jul. 15, 2006;177(2):976-82.
Klebanoff et al., "Sorting through subsets: Which T cell populations mediate highly effective adoptive immunotherapy?" J Immunother., (2012) 35(9):651-660.
Kochenderfer et al., "Construction and preclinical evaluation of an anti-CD19 chimeric antigen receptor," J. Immunotherapy, (2009) 32(7):689-702.
Koste et al., "T-cell receptor transfer into human T cells with ecotropic retroviral vectors," Gene Therapy, (2014) 21(5):533-8.
Kotb, "Bacterial pyrogenic exotoxins as superantigens," Clinical Microbiology Reviews, (1995) 8:411-426.
Kuball et al., "Facilitating matched pairing and expression of TCR chains introduced into human T cells," Blood, (2007) 109:2331-2338.
Lefranc et al., "IMGT unique numbering for immunoglobulin and T cell receptor variable domains and Ig superfamily V-like domains," Developmental and Comparative Immunology, (2003) 27(1):55-77.
Li et al., "Directed evolution of human T-cell receptors with picomolar affinities by phage display," Nat Biotechnol, (2005) 23(3):349-54.
Li et al., "Optimization of humanized IgGs in glycoengineered Pichia pastoris," Nat. Biotech., (2006) 24(2):210-215.
Lloyd et al., "Beyond the Antigen Receptor: Editing the Genome of T-Cells for Cancer Adoptive Cellular Therapies," Frontiers in Immunology, (2013) 4(221):1-7.
Lupton et al., "Dominant positive and negative selection using a hygromycin phosphotransferase-thymidine kinase fusion gene," Mol. And Cell Biol., (1991) 11(6):3374-8.
Lyford-Pike et al., "Evidence for a Role of the PD-1:PD-L1 Pathway in Immune Resistance of HPV-Associated Head and Neck Squamous Cell Carcinoma." Cancer Res. Mar. 15, 2013;73(6):1733-41.
Mali et al., "RNA-guided human genome engineering via Cas9," Science, (2013) 339(6121):823-826.
Manuri et al., "piggyBac Transposon/Transposase System to Generate CD19-Specific T Cells for the Treatment of B-Lineage Malignancies," Hum Gene Ther, (2010) 21(4): 427-437.
Miller and Rosman, "Improved retroviral vectors for gene transfer and expression," BioTechniques, (1989) 7(9):980-990.
Miller, "Retrovirus packaging cells," Human Gene Therapy, (1990) 1(1):5-14.
Moran et al., "T cell receptor signal strength in Treg and iNKT cell development demonstrated by a novel fluorescent reporter mouse." J Exp Med. Jun. 6, 2011;208(6):1279-89.
Mullen et al., "Transfer of the bacterial gene for cytosine deaminase to mammalian cells confers lethal sensitivity to 5-fluorocytosine: A negative selection system," Proc. Natl. Acad. Sci. USA, (1992) 89:33-37.

Nilges et al., "Human papillomavirus type 16 E7 peptide-directed CD8+ T cells from patients with cervical cancer are cross-reactive with the coronavirus NS2 protein," J Virol. May 2003;77(9):5464-74.
Okazaki et al., "Fucose depletion from human IgG1 oligosaccharide enhances binding enthalpy and association rate between IgG1 and FcgammaRIIIa," J. Mol. Biol., (2004) 336(5):1239-1249.
Osborn et al., "Evaluation of TCR Gene Editing Achieved by TALENs, CRISPR/Cas9, and megaTAL Nucleases," Mol. Ther., (2016) 24(3):570-581.
Park et al., "Treating cancer with genetically engineered T cells," Trends Biotechnol., (2011) 29(11):550-557.
Portolano et al., "Lack of promiscuity in autoantigen-specific H and L chain combinations as revealed by human H and L chain "roulette"." ," J. Immunol., (1993), 150:880-887.
Protocol Details "A Phase I/II Trial of T Cell Receptor Gene Therapy Targeting HPV-16 E7 with or without PD-1 Blockade for HPV-Associated Cancers." Record No. 16-C-0154; retrieved from https://clinicalstudies.info.nih.gov/ProtocolDetails.aspx?A_2016-C-0154.html; retrieved on Mar. 28, 2019.
Riddell et al., "Phase I study of cellular adoptive immunotherapy using genetically modified CD8+ HIV-specific T cells for HIV seropositive patients undergoing allogeneic bone marrow transplant," Human Gene Therapy, (1992) 3:319-338.
Riemer et al., "A conserved E7-derived cytotoxic T lymphocyte epitope expressed on human papillomavirus 16-transformed HLA-A2+ epithelial cancers," J Biol Chem (2010) 285(38):29608-29622.
Ripka et al., "Two Chinese hamster ovary glycosylation mutants affected in the conversion of GDP-mannose to GDP-fucose," Arch. Biochem. Biophys., (1986) 249(2):533-545.
Robbins et al., "Single and dual amino acid substitutions in TCR CDRs can enhance antigen-specific T cell functions," J Immunology, (2008) 180(9): 6116-6131.
Rosenberg, "Cell transfer immunotherapy for metastatic solid cancer—what clinicians need to know," Nat Rev Clin Oncol., (2011) 8(10):577-85.
Sadelain et al., "The basic principles of chimeric antigen receptor design," Cancer Discov. (2013) 3(4): 388-398.
Sander and Joung, "CRISPR-Cas systems for editing, regulating and targeting genomes," Nature Biotechnology, (2014) 32(4): 347-355.
Sanjana et al., "Improved vectors and genome-wide libraries for CRISPR screening," Nat. Methods, (2014) 11(8):783-4.
Scarpa et al., "Characterization of recombinant helper retroviruses from Moloney-based vectors in ecotropic and amphotropic packaging cell lines," Virology, (1991) 180(2):849-852.
Scatchard et al., "The Attractions of Proteins for Small Molecules and Ions," Ann. N.Y. Acad. Sci., (1949) 51(4):660-672.
Schlueter et al., "Specificity and binding properties of a single-chain T cell receptor," J. Mol. Biol., (1996) 256(5):859-69.
Sharma et al., "Efficient Sleeping Beauty DNA Transposition From DNA Minicircles," Molec Ther Nucl Acids, (2013) 2(2):e74.
Sitaraman et al., "High-throughput protein expression using cell-free system," Methods Mol. Biol., (2009) 498: 229-44.
Spirin, "High-throughput cell-free systems for synthesis of functionally active proteins," Trends Biotechnol., (2004) 22(10):538-45.
Stone et al., "Role of T cell receptor affinity in the efficacy and specificity of adoptive T cell therapies." Front Immunol. Aug. 21, 2013;4:244.
Stone et al., "T cell receptor binding affinities and kinetics: impact on T cell activity and specificity," Immunology. Feb. 2009;126(2):165-76.
Stone etl al., "Opposite effects of Endogenous Peptide—MHC Class I on T Cell Activity in the Presence and Absence of CD8." J Immunol. May 1, 2011;186(9):5193-200.
Swarts et al., "DNA-guided DNA interference by a prokaryotic Argonaute," Nature, (2014) 507(7491):258-261.
Szoka et al., "Comparative properties and methods of preparation of lipid vesicles (liposomes)," Ann. Rev. Biophys. Bioeng., (1980) 9:467-508.
Tang et al., "The advantages of PD1 activating chimeric receptor (PD1-ACR) engineered lymphocytes for PDL1+ cancer therapy," Am J Transl Res., (2015) 7(3):460-473.

(56) References Cited

OTHER PUBLICATIONS

Terakura et al., "Generation of CD19-chimeric antigen receptor modified CD8+ T cells derived from virus-specific central memory T cells," Blood, (2012) 119:72-82.
Themeli et al., "Generation of tumor-targeted human T lymphocytes from induced pluripotent stem cells for cancer therapy," Nat Biotechnol., (2013) 31(10): 928-933.
Thomas et al., "Molecular immunology lessons from therapeutic T-cell receptor gene transfer." Immunology. Feb. 2010;129(2):170-7.
Torikai et al., "A foundation for universal T-cell based immunotherapy: T cells engineered to express a CD19-specific chimeric-antigen-receptor and eliminate expression of endogenous TCR," Blood, (2012) 119(24):5697-5705.
Tsukahara et al., "CD19 target-engineered T-cells accumulate at tumor lesions in human B-cell lymphoma xenograft mouse models," Biochem Biophys Res Commun, (2013) 438(1): 84-9.
Turtle et al., "Engineered T cells for anti-cancer therapy," Curr. Opin. Immunol., (2012) 24(5): 633-39.
Van Loenen et al., "Mixed T cell receptor dimers harbor potentially harmful neoreactivity." Proc Natl Acad Sci U S A. Jun. 15, 2010;107(24):10972-7.
Van Tedeloo et al., "High-level transgene expression in primary human T lymphocytes and adult bone marrow CD34+ cells via electroporation-mediated gene delivery," Gene Therapy, (2000) 7(16):1431-1437.
Verhoeyen et al., "Lentiviral vector gene transfer into human T cells," Methods Mol Biol., (2009) 506:97-114.
Wadhwa et al., "Receptor mediated glycotargeting," J. Drug Targeting, (1995) 3(2):111-27.
Wang et al., "Phenotypic and Functional Attributes of Lentivirus Modified CD19-specific Human CD8+ Central Memory T Cells Manufactured at Clinical Scale," J Immunother., (2012) 35(9):689-701.
Weiss et al., "Requirement for the coexpression of T3 and the T cell antigen receptor on a malignant human T cell line," J. Ex. Med., (1984) 160(5):1284-1299.
Wigler et al., "Transfer of purified herpes virus thymidine kinase gene to cultured mouse cells," Cell (1977) 11(1):223-32.
Wilson, "Tech.Sight. Analyzing biomolecular interactions," Science, (2002) 295(5562):2103-5.
Wolff et al., "Monoclonal antibody homodimers: enhanced antitumor activity in nude mice," Cancer Res., (1993) 53(11):2560-5.
Wu et al., "Adoptive T-cell therapy using autologous tumor-infiltrating lymphocytes for metastatic melanoma: current status and future outlook," Cancer, (2012) 18(2):160-75.
Yamane-Ohnuki et al., "Establishment of FUT8 knockout Chinese hamster ovary cells: An ideal host cell line for producing completely defucosylated antibodies with enhanced antibody-dependent cellular cytotoxicity," Biotech. Bioeng., (2004) 87(5):614-622.
Youde et al., "Use of Fluorogenic Histocompatibility Leukocyte Antigen-A*0201/HPV 16 E7 Peptide Complexes to Isolate Rare Human Cytotoxic T-Lymphocyte-recognizing Endogenous Human Papillomavirus Antigens." Cancer Research Jan. 15, 2000;60:365-371.
Tsang et al., "Identification and Characterization of Enhancer Agonist Human Cytoxic T-cell Epitopes of the Human Papillomavirus Type 16 (HPV16) E6/E7," Vaccine (2017) 35(19): 2605-2611.

* cited by examiner

HPV-SPECIFIC BINDING MOLECULES

CROSS-REFERENCE TO RELATED APPLICATIONS

This application is a U.S. National Stage of International Application No. PCT/US2017/055005 filed Oct. 3, 2017, which claims priority from U.S. provisional application No. 62/403,661 filed Oct. 3, 2016, entitled "HPV-SPECIFIC BINDING MOLECULES," the contents of which are incorporated by reference in their entirety.

INCORPORATION BY REFERENCE OF SEQUENCE LISTING

The present application is being filed along with a Sequence Listing in electronic format. The Sequence Listing is provided as a file entitled 735042003800SeqList.txt, created Mar. 29, 2019, which is 2,095,795 bytes in size. The information in the electronic format of the Sequence Listing is incorporated by reference in its entirety.

FIELD

The present disclosure relates in some aspects to binding molecules, such as those that recognize or bind a peptide epitope of human papilloma virus (HPV) 16 E6 or E7 in the context of a major histocompatibility complex (MHC) molecule. In particular, the present disclosure relates to T cell receptors (TCRs) or antibodies, including antigen-binding fragments thereof, that bind or recognize a peptide epitope of HPV 16 E6 or E7. The present disclosure further relates to engineered cells comprising such binding molecules, e.g., TCRs or antibodies (and chimeric antigen receptors containing the antibodies), and uses thereof in adoptive cell therapy.

BACKGROUND

Human papillomavirus (HPV) is a common virus among human subjects that, in some cases, can be transmitted by skin-to-skin contact and is a common sexually transmitted virus. Certain subtypes of HPV, such as HPV 16, can lead to certain cancers, such as cervical and other cancers. In some cases, cancer can be associated with expression of the HPV oncoproteins E6 and/or E7. For example, HPV E6 and/or E7 may contribute to cancer progression by targeting tumor suppressor signaling pathways that are involved in cellular growth control. Certain therapeutic agents targeting HPV 16-expressing cells or cancers are available, but improved agents against HPV 16 are needed. Provided are embodiments that meet such needs.

SUMMARY

Provided herein is a binding molecule containing a first variable region containing a complementarity determining region 3 (CDR-3) containing an amino acid sequence set forth in any of SEQ ID NOs: 138, 144, 147, 153, 159, 163, 167, 173, 175, 301, 304, 308, 478, 493, 505, 511, 523, 539, 555, 572, 588, 600, 612, 624, 638, 650, 662, 679, 694, 712, 729, 744, 762, 776, 788, 802, 818, 832, 846, 858, 870, 882, 896, 911, 926, 940, 952, 964, 976, 988, or 1002, or a CDR3 contained within the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999; and/or a second variable region containing a complementarity determining region 3 (CDR-3) containing an amino acid sequence set forth in any of SEQ ID NOs: 141, 146, 150, 156, 160, 164, 170, 174, 178, 305, 309, 486, 499, 517, 531, 548, 563, 581, 594, 606, 618, 630, 644, 656, 670, 686, 703, 721, 736, 753, 769, 782, 794, 809, 825, 840, 852, 864, 876, 888, 902, 919, 932, 946, 958, 970, 982, 994, or 1010, or a CDR3 contained within the amino acid sequence set forth in any of SEQ ID NOs: 112, 114, 116, 118, 120, 122, 124, 126, 128, 296, 298, 300, 483, 498, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, or 1008. In some embodiments, the binding molecules bind or recognize a peptide epitope of HPV 16 E6 or E7.

In some embodiments, the first variable region further contains a complementarity determining region 1 (CDR-1) containing an amino acid sequence set forth in any of SEQ ID NOs: 136, 142, 151, 157, 161, 165, 171, 302, 306, 537, 570, 677, 692, 710, 727, 742, 760, 800, 816, 909, 938, or 1000, or a CDR-1 contained within the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999; and/or a complementarity determining region 2 (CDR-2) containing an amino acid sequence set forth in any of SEQ ID NOs: 137, 143, 152, 158, 162, 166, 172, 303, 307, 538, 571, 678, 693, 711, 728, 743, 761, 801, 817, 831, 833, 910, 939, or 1001, or a CDR-2 contained within the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999.

In some of any such embodiments, the second variable region contains a complementarity determining region 1 (CDR-1) containing an amino acid sequence set forth in any of SEQ ID NOs: 139, 145, 148, 154, 168, 176, 484, 546, 561, 579, 668, 701, 719, or 751 or a CDR-1 contained within the amino acid sequence set forth in any of SEQ ID NOs: 112, 114, 116, 118, 120, 122, 124, 126, 128, 296, 298, 300, 483, 498, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, or 1008; and/or a complementarity determining region 2 (CDR-2) containing an amino acid sequence set forth in any of SEQ ID NOs: 140, 149, 155, 169, 177, 485, 547, 562, 580, 669, 702, 720, 752, 918, or 1009, or a CDR-2 contained within the amino acid sequence set forth in any of SEQ ID NOs: 112, 114, 116, 118, 120, 122, 124, 126, 128, 296, 298, 300, 483, 498, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, or 1008.

In some of any such embodiments, the binding molecule is an antibody or antigen-binding fragment thereof. In some of any such embodiments, the binding molecule is a T cell receptor (TCR) or antigen-binding fragment thereof.

Provided herein is a T cell receptor (TCR) or antigen-binding fragment thereof, containing an alpha chain containing a variable alpha (Vα) region and a beta chain containing a variable beta (Vβ) region, wherein said Vα region contains the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999, or an amino acid sequence that has at least 90%, 91%, 92%, 93%, 94%, 95%, 96%, 97%, 98%, or 99% sequence identity thereto; and/or said Vβ region contains the amino acid sequence set forth in any of SEQ ID NOs: 112, 114, 116, 118, 120, 122, 124, 126, 128, 296, 298, 300, 483, 498, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, or 1008, or an amino acid sequence that has at least 90%, 91%, 92%, 93%, 94%, 95%, 96%, 97%, 98%, or 99% sequence identity thereto.

In some embodiments, said Vα region contains a complementarity determining region 3 (CDR-3) containing the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO: 251), wherein $X_1$ is A, I, or V; $X_2$ is M, L, V, E or A; $X_3$ is R, L, N, or S; $X_4$ is E, V, P, T, F, I, R or A; $X_5$ is G, I, L, A, P, R, D, or H; $X_6$ is R, T, G, S, N or H; $X_7$ is G, R, A, N, or null; $X_8$ is T, G, or null; $X_9$ is null, A or G; $X_{10}$ is null or G; $X_{11}$ is null or G; $X_{12}$ is null or T; $X_{13}$ is F, Y, A, S or null; $X_{14}$ is G, Y, or N; $X_{15}$ is F, G, T, N, Q, or Y; $X_{16}$ is K, P, V, N or A; $X_{17}$ is T, L, or F; and $X_{18}$ is I, V, T, H, or N; and/or said Vβ region contains a complementarity determining region 3 (CDR-3) containing the amino acid sequence $X_1X_2X_3X_4X_5X_6X_7X_8X_9X_{10}X_{11}X_{12}X_{13}X_{14}X_{15}$ (SEQ ID NO: 261), wherein $X_1$ is A or S; $X_2$ is 5, I, or V; $X_3$ is S, T, or V; $X_4$ is H, P, L, Y, T, D, or Q; $X_5$ is L, G, W, F, S, or R; $X_6$ is A, G, L, S, or T; $X_7$ is G, E, A, T, R, or null; $X_8$ is null or G; $X_9$ is null or G; $X_{10}$ is null, F, G, T, S, or A; $X_{11}$ is T, N, H, A, S, or F; $X_{12}$ is G, T, Q, D, Y, or L; $X_{13}$ is E, P, T, G or W; $X_{14}$ is L, A, Q, Y, or K; and $X_{15}$ is F, H, Y, or T.

In some of any such embodiments, said Vα region contains a complementarity determining region 1 (CDR-1) containing the amino acid sequence $X_1X_2X_3X_4X_5X_6X_7$ (SEQ ID NO: 243), wherein $X_1$ is T, D, N, or V; $X_2$ is I or S; $X_3$ is S, D, A, P, or M; $X_4$ is G, Q, P, or null; $X_5$ is T, S, I, or F; $X_6$ is D, Y, Q, T, or S; and $X_{7\ is}$ Y, G, N, or Q; or a complementarity determining region 2 (CDR-2) containing the amino acid sequence $X_1X_2X_3X_4X_5X_6X_7X_8$ (SEQ ID NO: 247), wherein $X_1$ is G, Q, I, V, or M; $X_2$ is L, S, Q, Y, F, T, or G; $X_3$ is T, G, S, or F; $X_4$ is Y, S, N, I, or null; $X_5$ is null or D; $X_6$ is null, E, Q, S, M, or K; $X_7$ is S, Q, R, G, D, or N; and $X_8$ is N, E, M, T, or K; and/or said Vβ region contains a complementarity determining region 1 (CDR-1) containing the amino acid sequence $X_1X_2X_3X_4X_5$ (SEQ ID NO: 254), wherein $X_1$ is S, M, or L; $X_2$ is G, E, D, N, or Q; $X_3$ is H or V; $X_4$ is V, N, E, L, or T; and $X_5$ is S, R, N, Y, A, or M; or a complementarity determining region 2 (CDR-2) containing the amino acid sequence $X_1X_2X_3X_4X_5X_6X_7$ (SEQ ID NO: 257), wherein $X_1$ is F, Y, S, or A; $X_2$ is Q, Y, V, or N; $X_3$ is N, D, G, F, or Q; $X_4$ is null or G; $X_5$ is E, V, N, K, or S; $X_6$ is A, K, G, or E; and $X_7$ is Q, M, T, I, or A.

In some of any such embodiments, the binding molecule or TCR or antigen-binding fragment thereof binds to or recognizes a peptide epitope of human papillomavirus (HPV) 16 E6 or E7 in the context of an MHC molecule. In some aspects, the binding molecule or TCR or antigen-binding fragment thereof binds to or recognizes a peptide epitope of human papillomavirus (HPV) 16 E6 in the context of an MHC molecule.

In some of any such embodiments, the peptide epitope derived from HPV16 E6 is or contains the amino acid sequence set forth in any of SEQ ID NOs: 232-234. In some embodiments, the peptide epitope derived from HPV16 E6 is or contains E6(29-38) TIHDIILECV (SEQ ID NO:233).

In some of any such embodiments, said Vα region contains a complementarity determining region 3 (CDR-3) containing the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO: 248), wherein $X_1$ is A, I, or V; $X_2$ is M, L, or V; $X_3$ is R, L, or N; $X_4$ is E, V, T, P, or F; $X_5$ is G, I, L, A, or P; $X_6$ is R, T, G, or S; $X_7$ is G, R, or null; $X_8$ is T, G, or null; $X_9$ is null or A; $X_{10}$ is null or G; $X_{11}$ is null or G; $X_{12}$ is null or T; $X_{13}$ is null or S; $X_{14}$ is G, Y, or N; $X_{15}$ is F, G, or T; $X_{16}$ is K or P; $X_{17}$ is T or L; and $X_{18}$ is I, V or T; and/or said Vβ region contains a complementarity determining region 3 (CDR-3) containing the amino acid sequence $ASSX_4X_5X_6X_7X_8X_9X_{10}X_{11}X_{12}X_{13}$ (SEQ ID NO: 258), wherein $X_4$ is H, P, L, or Y; $X_5$ is L, G, W, F, or S; $X_6$ is A, G, or L; $X_7$ is G, E, A, T, or null; $X_8$ is F, G, T, or S; $X_9$ is T, N, H, or A; $X_{10}$ is G, T, Q, D, or Y; $X_{11}$ is E, P, T, or G; $X_{12}$ is L, A, Q, or Y; and $X_{13}$ is F, H, Y, or T.

In some of any such embodiments, said Vα region contains a complementarity determining region 1 (CDR-1) containing the amino acid sequence $X_1X_2X_3X_4X_5X_6X_7$ (SEQ ID NO: 240), wherein $X_1$ is T, D, or N; $X_2$ is I, or S; $X_3$ is S, D, or A; $X_4$ is G, Q, P, or null; $X_5$ is T, S, or I; $X_6$ is D, Y, or Q; and $X_{7\ is}$ Y, G, N, or Q; or a complementarity determining region 2 (CDR-2) containing the amino acid sequence $X_1X_2X_3X_4X_5X_6X_7X_8$ (SEQ ID NO: 244), wherein $X_1$ is G, Q, I, or V; $X_2$ is L, S, Q, or Y; $X_3$ is T, G, or S; $X_4$ is Y, S, or null; $X_5$ is null or D; $X_6$ is null, E, Q, or S; $X_{7\ is}$ S, Q, R, or G; and $X_8$ is N or E; and/or said Vβ region contains a complementarity determining region 1 (CDR-1) containing the amino acid sequence $X_1X_2HX_4X_5$ (SEQ ID NO: 252), wherein $X_1$ is S or M; $X_2$ is G, E, D, or N; $X_4$ is V, N, or E; and $X_5$ is S, R, N, or Y; or a complementarity determining region 2 (CDR-2) containing the amino acid sequence $X_1X_2X_3X_4X_5X_6$ (SEQ ID NO: 255), wherein $X_1$ is F or S; $X_2$ is Q, Y, or V; $X_3$ is N, D, or G; $X_4$ is E or V; $X_5$ is A, K, or G; and $X_6$ is Q, M, or T.

In some of any such embodiments, said Vα region contains a complementarity determining region 3 (CDR-3) containing an amino acid sequence set forth in any of SEQ ID NOs: 138, 144, 147, 163, 167 173, 304, 308, 478, 493, 505, 511, 523, 539, 555, 572, 588, 600, 612, 624, 638, 650, 662, or 679, or a CDR3 contained within the amino acid sequence set forth in any of SEQ ID NOs: 111, 113, 115, 121, 123 125, 297, 299, 477, 492, 504, 510, 522, 536, 554, 569, 587, 599, 611, 623, 637, 649, 661, or 676; and/or a Vβ region containing a complementarity determining region 3 (CDR-3) containing an amino acid sequence set forth in any of SEQ ID NOs: 141, 146, 150, 164, 170, 174, 305, 309, 486, 499, 517, 531, 548, 563, 581, 594, 606, 618, 630, 644, 656, 670, or 686, or a CDR3 contained within the amino acid sequence set forth in any of SEQ ID NOs: 112, 114, 116, 122, 124 126, 298, 300, 483, 498, 498, 516, 530, 545, 560, 578, 593, 605, 617, 629, 643, 655, 667, or 685. In some aspects, the Vα region further contains a complementarity determining region 1 (CDR-1) containing an amino acid sequence set forth in any of SEQ ID NOs: 136, 142, 161, 165, 171, 302, 306, 537, 570, or 677, or a CDR-1 contained within the amino acid sequence set forth in any of SEQ ID NOs: 111, 113, 115, 121, 123, 125, 297, 299, 477, 492, 504, 510, 522, 536, 554, 569, 587, 599, 611, 623, 637, 649, 661, or 676; and/or a complementarity determining region 2 (CDR-2) containing an amino acid sequence set forth in any of SEQ ID NOs: 137, 143, 162, 166, 172, 303, 307, 538, 571, or 678, or a CDR-2 contained within the amino acid sequence set forth in any of SEQ ID NOs: 111, 113, 115, 121, 123, 125, 297, 299, 477, 492, 504, 510, 522, 536, 554, 569, 587, 599, 611, 623, 637, 649, 661, or 676.

In some of any such embodiments, the Vβ region contains a complementarity determining region 1 (CDR-1) containing an amino acid sequence set forth in any of SEQ ID NOs: 139, 145, 148, 168, 484, 546, 561, 579, or 668, or a CDR-1 contained within the amino acid sequence set forth in any of SEQ ID NOs: 112, 114, 116, 122, 124, 126, 298, 300, 483, 498, 498, 516, 530, 545, 560, 578, 593, 605, 617, 629, 643, 655, 667, or 685; and/or a complementarity determining region 2 (CDR-2) containing an amino acid sequence set forth in any of SEQ ID NOs: 140, 149, 169, 485, 547, 562, 580, or 669, or a CDR-2 contained within the amino acid sequence set forth in any of SEQ ID NOs: 112, 114, 116, 122, 124, 126, 298, 300, 483, 498, 498, 516, 530, 545, 560, 578, 593, 605, 617, 629, 643, 655, 667, or 685.

In some of any such embodiments, said Vα region contains a complementarity determining region 1 (CDR-1) containing an amino acid sequence set forth in any of SEQ ID NOs: 136, 142, 161, 165, 171, 302, 306, 537, 570, or 677; a complementarity determining region 2 (CDR-2) containing an amino acid sequence set forth in any of SEQ ID NOs: 137, 143, 162, 166, 172, 303, 307, 538, 571, or 678; and/or a complementarity determining region 3 (CDR-3) containing an amino acid sequence set forth in any of SEQ ID NOs: 138, 144, 147, 163, 167, 173, 304, 308, 478, 493, 505, 511, 523, 539, 555, 572, 588, 600, 612, 624, 638, 650, 662, 679; and/or said Vβ region contains a complementarity determining region 1 (CDR-1) containing an amino acid sequence set forth in any of SEQ ID NOs: 139, 145, 148, 168, 484, 546, 561, 579, or 668; a complementarity determining region 2 (CDR-2) containing an amino acid sequence set forth in any of SEQ ID NOs: 140, 149 or 169; and/or a complementarity determining region 3 (CDR-3) containing an amino acid sequence set forth in any of SEQ ID NOs: 141, 146, 150, 164, 170, 174, 305, 309, 486, 499, 517, 531, 548, 563, 581, 594, 606, 618, 630, 644, 656, 670, or 686.

In some of any such embodiments, said Vα region contains a CDR-1, CDR-2, and CDR-3, containing the amino acid sequences of SEQ ID NOs: 136, 137, and 138, respectively, and said Vβ region contains a CDR-1, CDR-2, and CDR-3, containing the amino acid sequences of SEQ ID NOs: 139, 140, and 141, respectively; said Vα region contains a CDR-1, CDR-2, and CDR-3, containing the amino acid sequences of SEQ ID NOs: 142, 143, and 144, respectively, and said Vβ region contains a CDR-1, CDR-2, and CDR-3, containing the amino acid sequences of SEQ ID NOs: 145, 140, and 146, respectively; said Vα region contains a CDR-1, CDR-2, and CDR-3, containing the amino acid sequences of SEQ ID NOs: 136, 137, and 147, respectively, and said Vβ region contains a CDR-1, CDR-2, and CDR-3, containing the amino acid sequences of SEQ ID NOs: 148, 149, and 150, respectively; said Vα region contains a CDR-1, CDR-2, and CDR-3, containing the amino acid sequences of SEQ ID NOs: 161, 162, and 163, respectively, and said Vβ region contains a CDR-1, CDR-2, and CDR-3, containing the amino acid sequences of SEQ ID NOs: 148, 149, and 164, respectively; said Vα region contains a CDR-1, CDR-2, and CDR-3, containing the amino acid sequences of SEQ ID NOs: 165, 166, and 167, respectively, and said Vβ region contains a CDR-1, CDR-2, and CDR-3, containing the amino acid sequences of SEQ ID NOs: 168, 169, and 170, respectively; said Vα region contains a CDR-1, CDR-2, and CDR-3, containing the amino acid sequences of SEQ ID NOs: 171, 172, and 173, respectively, and said Vβ region contains a CDR-1, CDR-2, and CDR-3, containing the amino acid sequences of SEQ ID NOs: 148, 149, and 174, respectively; said Vα region contains a CDR-1, CDR-2, and CDR-3, containing the amino acid sequences of SEQ ID NOs: 302, 303, and 304, respectively, and said Vβ region contains a CDR-1, CDR-2, and CDR-3, containing the amino acid sequences of SEQ ID NOs: 139, 140, and 305, respectively; or said Vα region contains a CDR-1, CDR-2, and CDR-3, containing the amino acid sequences of SEQ ID NOs: 306, 307, and 308, respectively, and said Vβ region contains a CDR-1, CDR-2, and CDR-3, containing the amino acid sequences of SEQ ID NOs: 148, 149, and 309, respectively.

In some of any such embodiments, said Vα region contains a complementarity determining region 1 (CDR-1), a CDR-2, and a CDR-3, respectively containing the CDR-1, CDR-2, and CDR-3 amino acid sequences contained within a Vα region amino acid sequence set forth in any of SEQ ID NOs: 111, 113, 115, 121, 123, 125, 297, 299, 477, 492, 504, 510, 522, 536, 554, 569, 587, 599, 611, 623, 637, 649, 661, or 676; and/or said Vβ region contains a complementarity determining region 1 (CDR-1), a CDR-2, and a CDR-3, respectively containing the CDR-1, CDR-2, and CDR-3 amino acid sequences contained within a Vβ region amino acid sequence set forth in any of SEQ ID NOs: 112, 114, 116, 122, 124, 126, 298, 300, 483, 498, 498, 516, 530, 545, 560, 578, 593, 605, 617, 629, 643, 655, 667, or 685.

In some of any such embodiments, the Vα and Vβ regions include the amino acid sequences of SEQ ID NOs: 111 and 112, respectively; the Vα and Vβ regions include the amino acid sequences of SEQ ID NOs: 113 and 114, respectively; the Vα and Vβ regions include the amino acid sequences of SEQ ID NOs: 115 and 116, respectively; the Vα and Vβ regions include the amino acid sequences of SEQ ID NOs: 121 and 122, respectively; the Vα and Vβ regions include the amino acid sequences of SEQ ID NOs: 123 and 124, respectively; the Vα and Vβ regions include the amino acid sequences of SEQ ID NOs: 125 and 126, respectively; the Vα and Vβ regions include the amino acid sequences of SEQ ID NOs: 297 and 298, respectively; the Vα and Vβ regions include the amino acid sequences of SEQ ID NOs: 299 and 300, respectively.

In some of any such embodiments, the binding molecule or TCR or antigen-binding fragment thereof binds to or recognizes a peptide epitope of human papillomavirus (HPV) 16 E7 in the context of an MHC molecule.

Provided herein is a T cell receptor (TCR) or antigen-binding fragment thereof, containing an alpha chain containing a variable alpha (Vα) region and a beta chain containing a variable beta (Vβ) region, wherein the TCR or antigen-binding fragment thereof binds to or recognizes a peptide epitope of human papillomavirus (HPV) 16 E7 in the context of an MHC molecule. In some embodiments, the peptide epitope derived from HPV16 E7 is or contains the amino acid sequence set forth in any of SEQ ID NOs: 235-239. In some aspects, the peptide epitope derived from HPV16 E7 is or contains E7(11-19) YMLDLQPET (SEQ ID NO:236).

In some of any such embodiments, said Vα region contains a complementarity determining region 3 (CDR-3) containing the amino acid sequence $X_1X_2SX_4X_5X_6X_7X_8X_9X_{10}X_{11}$ (SEQ ID NO: 249), wherein $X_1$ is A or V; $X_2$ is E or V; $X_4$ is I or R; $X_5$ is R or D; $X_6$ is G or N; $X_7$ is F or Y; $X_8$ is N or Q; $X_9$ is V or N; $X_{10}$ is L or F; and $X_{11}$ is H or V; and/or said Vβ region contains a complementarity determining region 3 (CDR-3) containing the amino acid sequence $AX_2TX_4RX_6X_7YX_9X_{10}X_{11}$ (SEQ ID NO: 259), wherein $X_2$ is S or I; $X_4$ is T or D; $X_6$ is S or T; $X_7$ is S or N; $X_9$ is E or G; $X_{10}$ is Q or Y; and $X_{11}$ is Y or T.

In some of any such embodiments, said Vα region contains a complementarity determining region 1 (CDR-1) containing the amino acid sequence $X_1SX_3X_4X_5X_6$ (SEQ ID NO: 241), wherein $X_1$ is D or V; $X_3$ is S, or P; $X_4$ is S or F; $X_5$ is T or S; and $X_{6\ is}$ Y or N; or a complementarity determining region 2 (CDR-2) containing the amino acid sequence $X_1X_2X_3X_4X_5X_6X_7$ (SEQ ID NO: 245), wherein $X_1$ is I or M; $X_2$ is F or T; $X_3$ is S or F; $X_4$ is N or S; $X_5$ is M or E; $X_6$ is D or N; and $X_7$ is M or T; and/or said Vβ region contains a complementarity determining region 1 (CDR-1) containing the amino acid sequence set forth in SEQ ID NO: 154; or a complementarity determining region 2 (CDR-2) containing the amino acid sequence set forth in SEQ ID NO: 155.

In some of any such embodiments, said Vα region contains a complementarity determining region 3 (CDR-3) containing the amino acid sequence set forth in any of SEQ ID NOs: 153, 159, 301, 694, 712, 729, 744, 762, 776, 788, 802, 818, 832, 846, 858, 870, 882, 896, 911, 926, 940, 952, 964, 976, 988, or 1002, or a CDR3 contained within the amino acid sequence set forth in any of SEQ ID NOs: 117, 119, or 295; and/or said Vβ region contains a complementarity determining region 3 (CDR-3) containing an amino acid sequence set forth in any of SEQ ID NOs: 156, 160, 703, 721, 736, 753, 769, 782, 794, 809, 825, 840, 852, 864, 876, 888, 902, 919, 932, 946, 958, 970, 982, 994, or 1010, or a CDR3 contained within the amino acid sequence set forth in any of SEQ ID NOs: 118, 120, 296, 700, 718, 735, 750, 768, 781, 793, 808, 824, 839, 851, 863, 875, 887, 901, 917, 931, 945, 957, 969, 981, 993, or 1008. In some embodiments, the Vα region further contains a complementarity determining region 1 (CDR-1) containing an amino acid sequence set forth in any of SEQ ID NOs: 151, 157, 692, 710, 727, 742, 760, 800, 816, 909, 938, or 1000; and/or a complementarity determining region 2 (CDR-2) containing an amino acid sequence set forth in any of SEQ ID NOs: 152, 158, 693, 711, 728, 743, 761, 801, 817, 831, 833, 910, 939, or 1001.

In some of any such embodiments, the Vβ region contains a complementarity determining region 1 (CDR-1) containing the amino acid sequence set forth in SEQ ID NO: 154; and/or a complementarity determining region 2 (CDR-2) containing the amino acid sequence set forth in SEQ ID NO: 155.

In some of any such embodiments, said Vα region contains a CDR-1, CDR-2, and CDR-3, containing the amino acid sequences of SEQ ID NOs: 151, 152, and 153, respectively, and said Vβ region contains a CDR-1, CDR-2, and CDR-3, containing the amino acid sequences of SEQ ID NOs: 154, 155, and 156, respectively; said Vα region contains a CDR-1, CDR-2, and CDR-3, containing the amino acid sequences of SEQ ID NOs: 157, 158, and 159, respectively, and said Vβ region contains a CDR-1, CDR-2, and CDR-3, containing the amino acid sequences of SEQ ID NOs: 154, 155, and 160, respectively; or said Vα region contains a CDR-1, CDR-2, and CDR-3, containing the amino acid sequences of SEQ ID NOs: 151, 152, and 301, respectively, and said Vβ region contains a CDR-1, CDR-2, and CDR-3, containing the amino acid sequences of SEQ ID NOs: 154, 155, and 156, respectively.

In some of any such embodiments, said Vα region contains a complementarity determining region 1 (CDR-1), a CDR-2, and a CDR-3, respectively containing the CDR-1, CDR-2, and CDR-3 amino acid sequences contained within a Vα region amino acid sequence set forth in any of SEQ ID NOs: 117, 119, or 295; and/or said Vβ region contains a complementarity determining region 1 (CDR-1), a CDR-2, and a CDR-3, respectively containing the CDR-1, CDR-2, and CDR-3 amino acid sequences contained within a Vβ region amino acid sequence set forth in any of SEQ ID NOs: 118, 120, 296, 700, 718, 735, 750, 768, 781, 793, 808, 824, 839, 851, 863, 875, 887, 901, 917, 931, 945, 957, 969, 981, 993, or 1008.

In some of any such embodiments, the Vα and Vβ regions include the amino acid sequences of SEQ ID NOs: 117 and either 118 or 296, respectively; the Vα and Vβ regions include the amino acid sequences of SEQ ID NOs: 119 and 120, respectively; or the Vα and Vβ regions include the amino acid sequences of SEQ ID NOs: 295 and either 118 or 296, respectively.

In some of any such embodiments, the peptide epitope derived from HPV16 E7 is or contains E7(86-93) TLGIVCPI (SEQ ID NO:235).

In some of any such embodiments, said Vα region contains a complementarity determining region 3 (CDR-3) containing the amino acid sequence set forth in SEQ ID NO: 175; and/or said Vβ region contains a complementarity determining region 3 (CDR-3) containing the amino acid sequence set forth in any of SEQ ID NO: 178. In some embodiments, the Vα region contains a complementarity determining region 1 (CDR-1) containing the amino acid sequence set forth in SEQ ID NO: 142; and/or a complementarity determining region 2 (CDR-2) containing the amino acid sequence set forth in SEQ ID NO: 143.

In some embodiments, said Vβ region contains a complementarity determining region 1 (CDR-1) containing an amino acid sequence set forth in SEQ ID NOs: 176; and/or a complementarity determining region 2 (CDR-2) containing an amino acid sequence set forth in SEQ ID NOs: 177, said Vα region contains a CDR-1, CDR-2, and CDR-3, containing the amino acid sequences of SEQ ID NOs: 142, 143, and 175, respectively, and said Vβ region contains a CDR-1, CDR-2, and CDR-3, containing the amino acid sequences of SEQ ID NOs: 176, 177, and 178, respectively.

In some of any such embodiments, said Vα region contains a complementarity determining region 1 (CDR-1), a CDR-2, and a CDR-3, respectively containing the CDR-1, CDR-2, and CDR-3 amino acid sequences contained within a Vα region amino acid sequence set forth in SEQ ID NO: 127; and/or said Vβ region contains a complementarity determining region 1 (CDR-1), a CDR-2, and a CDR-3, respectively containing the CDR-1, CDR-2, and CDR-3 amino acid sequences contained within a Vβ region amino acid sequence set forth in SEQ ID NO: 128.

In some of any such embodiments, the Vα and Vβ regions contain the amino acid sequences of SEQ ID NOs: 127 and 128, respectively.

In some of any such embodiments, the alpha chain further contains an alpha constant (Cα) region and/or the beta chain further contains a beta constant (Cβ) region. In some aspects, the Cα and Cβ regions are mouse constant regions. In some embodiments, said Cα region contains the amino acid sequence set forth in SEQ ID NO: 262, or a sequence of amino acids that has at least 90% sequence identity thereto; and/or said Cβ region contains the amino acid sequence set forth in SEQ ID NO: 263, or a sequence of amino acids that has at least 90% sequence identity thereto. In some instances, the Cα and Cβ regions are human constant regions.

In some of any such embodiments, said Cα region contains the amino acid sequence set forth in any of SEQ NOs: 212, 213, 215, 217, 218, 220, or 524, or a sequence of amino acids that has at least 90% sequence identity thereto; and/or said Cβ region contains the amino acid sequence set forth in any of SEQ ID NOs: 214, 216, 631, or 889, or a sequence of amino acids that has at least 90% sequence identity thereto.

In some of any such embodiments, the TCR or antigen-binding fragment thereof containing one or more modifications in the α chain and/or β chain such that when the TCR or antigen-binding fragment thereof is expressed in a cell, the frequency of mispairing between the TCR α chain and β chain and an endogenous TCR α chain and β chain is reduced, the expression of the TCR α chain and β chain is increased and/or the stability of the TCR α chain and β chain is increased. In some embodiments, the one or more modifications is a replacement, deletion, or insertion of one or more amino acids in the Cα region and/or the Cβ region. In some aspects, the one or more modifications contain replacement(s) to introduce one or more cysteine residues that are capable of forming one or more non-native disulfide bridges between the alpha chain and beta chain.

In some of any such embodiments, the TCR or antigen-binding fragment thereof contains a Cα region containing a cysteine at a position corresponding to position 48 with numbering as set forth in SEQ ID NO: 212, 213, 215, 217, 218, 220, or 524, and/or a Cβ region containing a cysteine at a position corresponding to position 57 with numbering as set forth in SEQ ID NO: 214, 216, 631, or 889. In some embodiments, said Cα region contains the amino acid sequence set forth in any of SEQ ID NOs: 196, 198, 200, 201, 203, or 525, or a sequence of amino acids that has at least 90% sequence identity thereto containing one or more cysteine residues capable of forming a non-native disulfide bond with the beta chain; and/or said Cβ region contains the amino acid sequence set forth in any of SEQ ID NOs: 197, 199, 632, or 890, or a sequence of amino acids that has at least 90% sequence identity thereto that contains one or more cysteine residues capable of forming a non-native disulfide bond with the alpha chain.

In some of any such embodiments, the TCR or antigen-binding fragment thereof is encoded by a nucleotide sequence that has been codon-optimized.

In some of any such embodiments, a) said alpha chain contains the amino acid sequence set forth in any of SEQ ID NOs: 18, 28, 38, 68, 78, 88, 287, 291, 473, 488, 500, 506, 518, 532, 550, 565, 583, 595, 607, 619, 633, 645, 657, or 672, a sequence of amino acids that has at least 90% sequence identity thereto; or an amino acid sequence encoded by the nucleotide sequence set forth in any of SEQ ID NOs: 20, 30, 40, 70, 80, 90, 100, 202, 219, 389, 430, 1019, 1021, 1023, 1025, 1027, 1029, 1031, 1033, 1035, 1037, 1039, 1041, 1043, 1045 or a nucleotide sequence that has at least 90% sequence identity thereto; and/or said beta chain contains an amino acid sequence set forth in any of SEQ ID NOs: 22, 32, 42, 72, 82, 92, 289, 293, 479, 494, 512, 526, 541, 556, 574, 589, 601, 613, 625, 639, 651, 663, or 681, a sequence of amino acids that has at least 90% sequence identity thereto; or an amino acid sequence encoded by the nucleotide sequence set forth in any of SEQ ID NOS: 16, 17, 24, 34, 44, 74, 84, 94, 104, 390, 431, 1020, 1022, 1024, 1026, 1028, 1030, 1032, 1034, 1036, 1038, 1040, 1042, 1044, 1046, or a nucleotide sequence that has at least 90% sequence identity thereto; or b) the alpha and beta chains contain the amino acid sequences of SEQ ID NOs: 18 and 22, respectively; the alpha and beta chains contain the amino acid sequences of SEQ ID NOs: 28 and 32, respectively; the alpha and beta chains contain the amino acid sequences of SEQ ID NOs: 38 and 42, respectively; the alpha and beta chains contain the amino acid sequences of SEQ ID NOs: 68 and 72, respectively; the alpha and beta chains contain the amino acid sequences of SEQ ID NOs: 78 and 82, respectively; the alpha and beta chains contain the amino acid sequences of SEQ ID NOs: 88 and 92, respectively, the alpha and beta chains contain the amino acid sequences of SEQ ID NOs: 287 and 289, respectively, or the alpha and beta chains contain the amino acid sequences of SEQ ID NOs: 291 and 293, respectively.

In some of any such embodiments, a) said alpha chain contains the amino acid sequence set forth in any of SEQ ID NOs: 19, 29, 39, 69, 89, 288, 292, 474, 489, 501, 507, 519, 533, 551, 566, 584, 596, 608, 620, 634, 646, 658, or 673, a sequence of amino acids that has at least 90% sequence identity thereto that contains one or more cysteine residues capable of forming a non-native disulfide bond with the beta chain; or an amino acid sequence encoded by the nucleotide sequence set forth in any of SEQ ID NOs: 10, 11, 21, 31, 41, 71, 81, 91, 101, 1097, 1099, 1101, 1103, 1105, 1107, 1109, 1111, 1113, 1115, 1117, 1119, 1121, 1123, 1125, 1127, or a nucleotide sequence that has at least 90% sequence identity thereto and encodes an alpha chain that contains one or more cysteine residues capable of forming a non-native disulfide bond with the beta chain; and/or said beta chain contains an amino acid sequence set forth in any of SEQ ID NOs: 23, 33, 43, 73, 83, 93, 290, 294, 480, 495, 513, 527, 542, 557, 575, 590, 602, 614, 626, 640, 652, 664, or 682, a sequence of amino acids that has at least 90% sequence identity thereto that contains one or more cysteine residues capable of forming a non-native disulfide bond with the alpha chain; or an amino acid sequence encoded by the nucleotide sequence set forth in any of SEQ ID NOs: 7, 8, 25, 35, 45, 75, 85, 95, 105, 1098, 1100, 1102, 1104, 1106, 1108, 1110, 1112, 1114, 1116, 1118, 1120, 1122, 1124, 1126, 1128, or a nucleotide sequence that has at least 90% sequence identity thereto and encodes a beta chain that contains one or more cysteine residues capable of forming a non-native disulfide bond with the alpha chain; or b) the alpha and beta chains contain the amino acid sequences of SEQ ID NOs: 19 and 23, respectively; the alpha and beta chains contain the amino acid sequences of SEQ ID NOs: 29 and 33, respectively; the alpha and beta chains contain the amino acid sequences of SEQ ID NOs: 39 and 43, respectively; the alpha and beta chains contain the amino acid sequences of SEQ ID NOs: 69 and 73, respectively; the alpha and beta chains contain the amino acid sequences of SEQ ID NOs: 79 and 83, respectively; the alpha and beta chains contain the amino acid sequences of SEQ ID NOs: 89 and 93, respectively, the alpha and beta chains contain the amino acid sequences of SEQ ID NOs: 288 and 290, or the alpha and beta chains contain the amino acid sequences of SEQ ID NOs: 292 and 294.

In some of any such embodiments, a) said alpha chain contains the amino acid sequence set forth in SEQ ID NOs: 48, 58, 283, 687, 705, 722, 737, 755, 771, 783, 795, 811, 826, 841, 853, 865, 877, 891, 904, 921, 933, 947, 959, 971, 983, or 995, a sequence of amino acids that has at least 90% sequence identity thereto; or an amino acid sequence encoded by the nucleotide sequence set forth in any of SEQ ID NOs: 50, 60, 183, 1049, 1051, 1055, 1057, 1059, 1061, 1063, 1065, 1067, 1069, 1071, 1073, 1075, 1077, 1079, 1081, 1083, 1085, 1087, 1089, 1091, 1093, 1095, 1225, 1226, or a nucleotide sequence that has at least 90% sequence identity thereto; and/or said beta chain contains an amino acid sequence set forth in SEQ ID NOs: 52, 62, 285, 696, 714, 731, 746, 764, 777, 789, 804, 820, 835, 847, 859, 871, 883, 897, 913, 927, 941, 953, 965, 977, 989, or 1004, a sequence of amino acids that has at least 90% sequence identity thereto; or an amino acid sequence encoded by the nucleotide sequence set forth in SEQ ID NOS: 55, 64, 108, 1050, 1052, 1056, 1058, 1060, 1062, 1064, 1066, 1068, 1070, 1072, 1074, 1076, 1078, 1080, 1082, 1084, 1086, 1088, 1090, 1092, 1094, 1224, 1227, 1228, or a nucleotide sequence that has at least 90% sequence identity thereto; or b) the alpha and beta chains contain the amino acid sequences of SEQ ID NOs: 48 and either 52 or 285, respectively; the alpha and beta chains contain the amino acid sequences of SEQ ID NOs: 58 and 62, respectively; or the alpha and beta chains contain the amino acid sequences of SEQ ID NOs: 283 and either 52 or 285, respectively.

In some of any such embodiments, a) said alpha chain contains the amino acid sequence set forth in SEQ ID NOs: 49, 59, 284, 688, 706, 723, 738, 756, 772, 784, 796, 812, 827, 842, 854, 866, 878, 892, 905, 922, 934, 948, 960, 972, 984, or 996, a sequence of amino acids that has at least 90% sequence identity thereto that contains one or more cysteine residues capable of forming a non-native disulfide bond with the beta chain; or an amino acid sequence encoded by the nucleotide sequence set forth in any of SEQ ID NOs: 12, 51, 61, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, or a nucleotide sequence that has at least 90% sequence identity thereto and encodes an alpha chain that contains one or more cysteine residues capable of forming a non-native disulfide bond with the beta chain; and/or said beta chain contains an amino acid sequence set forth in SEQ ID NOs: 53, 63, 286, 697, 715, 732, 747, 765, 778, 790, 805, 821, 836, 848, 860, 872, 884, 898, 914, 928, 942, 954, 966, 978, 990, or 1005, a sequence of amino acids that has at least 90% sequence identity thereto that contains one or more cysteine residues capable of forming a non-native disulfide bond with the alpha chain; or an amino acid sequence encoded by the nucleotide sequence set forth in SEQ ID NOS: 9, 54, or 65, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, or a nucleotide sequence that has at least 90% sequence identity thereto and encodes a beta chain that contains one or more cysteine residues capable of forming a non-native disulfide bond with the alpha chain; or b) the alpha and beta chains contain the amino acid sequences of SEQ ID NOs: 49 and 53, respectively; the alpha and beta chains contain the amino acid sequences of SEQ ID NOs: 59 and 63, respectively; or the alpha and beta chains contain the amino acid sequences of SEQ ID NOs: 284 and 286, respectively.

In some of any such embodiments, a) said alpha chain contains the amino acid sequence set forth in SEQ ID NO: 98, a sequence of amino acids that has at least 90% sequence identity thereto; or an amino acid sequence encoded by the nucleotide sequence set forth in SEQ ID NO: 100, or a nucleotide sequence that has at least 90% sequence identity thereto; and/or said beta chain contains an amino acid sequence set forth in SEQ ID NO: 102, a sequence of amino acids that has at least 90% sequence identity thereto; or an amino acid sequence encoded by the nucleotide sequence set forth in SEQ ID NO: 104, or a nucleotide sequence that has at least 90% sequence identity thereto; or b) the alpha and beta chains contain the amino acid sequences of SEQ ID NOs: 98 and 102, respectively.

In some of any such embodiments, a) said alpha chain contains the amino acid sequence set forth in SEQ ID NO: 99, a sequence of amino acids that has at least 90% sequence identity thereto that contains one or more cysteine residues capable of forming a non-native disulfide bond with the beta chain; or an amino acid sequence encoded by the nucleotide sequence set forth in SEQ ID NO: 101, or a nucleotide sequence that has at least 90% sequence identity thereto and encodes an alpha chain that contains one or more cysteine residues capable of forming a non-native disulfide bond with the beta chain; and/or said beta chain contains an amino acid sequence set forth in SEQ ID NO: 103, a sequence of amino acids that has at least 90% sequence identity thereto that contains one or more cysteine residues capable of forming a non-native disulfide bond with the alpha chain; or an amino acid sequence encoded by the nucleotide sequence set forth in SEQ ID NO: 105, or a nucleotide sequence that has at least 90% sequence identity thereto and encodes a beta chain that contains one or more cysteine residues capable of forming a non-native disulfide bond with the alpha chain; or b) the alpha and beta chains contain the amino acid sequences of SEQ ID NOs: 99 and 103, respectively.

In some of any such embodiments, the TCR or antigen-binding fragment thereof further contains a signal peptide. In some embodiments, the signal peptide contains the amino acid sequence set forth in any of SEQ ID NOs: 181, 184, 187, 189, 190, 192, 193, 310, 311, 182, 185, 186, 188, 191, 194, 487, 540, 549, 564, 573, 582, 671, 680, 695, 704, 713, 730, 745, 754, 763, 770, 803, 810, 819, 834, 903, 912, 920, 1003, or 1011.

In some of any such embodiments, the binding molecule or TCR or antigen-binding fragment thereof is isolated or purified or is recombinant. In some of any such embodiments, the binding molecule or TCR or antigen-binding fragment thereof is human.

In some of any such embodiments, the binding molecule or TCR or antigen-binding fragment thereof is monoclonal. In some of any such embodiments, the binding molecule or TCR or antigen-binding fragment thereof is single chain. In some of any such embodiments, the binding molecule or TCR or antigen-binding fragment thereof contains two chains.

In some of any such embodiments, the antigen-specificity is at least partially CD8-independent. In some of any such embodiments, the MHC molecule is an HLA-A2 molecule.

Provided herein is a nucleic acid molecule encoding the binding molecule or the TCR or antigen-binding fragment thereof according to any one of the embodiments described above. In some embodiments, the nucleic acid molecule containing a nucleotide sequence encoding an alpha chain and/or a nucleotide sequence encoding a beta chain, wherein said nucleotide sequence encoding an alpha chain contains the sequence selected from the group consisting of residues 61-816 of SEQ ID NO: 20, residues 58-804 of SEQ ID NO: 30, residues 61-825 of SEQ ID NO: 40, residues 64-813 of SEQ ID NO: 50, residues 64-816 of SEQ ID NO: 60, residues 58-807 of SEQ ID NO: 70, residues 61-825 of SEQ ID NO: 80, residues 67-831 of SEQ ID NO: 90, residues 58-801 of SEQ ID NO: 100, or a sequence having at least 90% sequence identity thereto; and/or said nucleotide sequence encoding a beta chain contains the sequence selected from the group consisting of residues 58-936 of SEQ ID NO: 17, residues 58-930 of SEQ ID NO: 16, residues 58-939 of SEQ ID NO: 24, residues 64-930 of SEQ ID NO: 34 or 44, residues 58-933 of SEQ ID NO: 55, residues 58-927 of SEQ ID NO: 64, residues 64-936 of SEQ ID NO: 74, residues 58-933 of SEQ ID NO: 84, residues 63-930 of SEQ ID NO: 94, residues 46-936 of SEQ ID NO: 104, residues 58-933 of SEQ ID NO: 108, or a sequence having at least 90% sequence identity thereto. In some instances, the nucleotide sequence is codon-optimized.

In some of any such embodiments, the nucleic acid molecule containing a nucleotide sequence encoding an alpha chain and/or a nucleotide sequence encoding a beta chain, wherein said nucleotide sequence encoding an alpha chain contains the sequence selected from the group consisting of residues 67-825 of SEQ ID NO: 10, residues 58-813 of SEQ ID NO: 11, residues 64-822 of SEQ ID NO: 12 residues 61-825 of SEQ ID NO: 21, residues 58-813 of SEQ ID NO: 31, residues 61-834 of SEQ ID NO: 41, residues 63-822 of SEQ ID NO: 51, residues 64-825 of SEQ ID NO: 61, residues 58-816 of SEQ ID NO: 71, residues 61-834 of SEQ ID NO: 81, residues 67-840 of SEQ ID NO: 91, residues 58-810 of SEQ ID NO: 101, or a sequence having at least 90% sequence identity thereto; and/or said nucleotide sequence encoding a beta chain contains the sequence selected from the group consisting of residues 58-939 of SEQ ID NO: 25, residues 64-930 of SEQ ID NO: 35, 45, or 95, residues 58-933 of SEQ ID NO: 54 or 85, residues 58-927 of SEQ ID NO: 65, residues 64-936 of SEQ ID NO: 75, residues 46-936 of SEQ ID NO: 105, or a sequence having at least 90% sequence identity thereto.

In some of any such embodiments, the nucleotide sequence encoding the alpha chain and the nucleotide sequence encoding the beta chain are separated by a nucleotide sequence encoding an internal ribosome entry site (IRES) or a peptide sequence that causes ribosome skipping. In some aspects, the nucleotide sequence encoding the alpha chain and the nucleotide sequence encoding the beta chain are separated by a peptide sequence that causes ribosome skipping. In some embodiments, the peptide that causes ribosome skipping is a P2A or T2A peptide and/or contains the sequence of amino acids set forth in SEQ ID NO: 204 or 211.

In some of any such embodiments, provided herein is a nucleic acid containing the nucleotide sequence set forth in any of SEQ ID NOs: 13, 14, 15, 26, 36, 46, 56, 66, 76, 86, 96, 106, 432-472, or a nucleotide sequence having at least 90% sequence identity thereto. In some of any such embodiments, the nucleic acid is synthetic. In some of any such embodiments, the nucleic acid is cDNA.

Provided herein is a vector containing the nucleic acid according to any one of the embodiments described above. In some instances, the vector is an expression vector. In some embodiments, the vector is a viral vector. In some embodiments, the viral vector is a retroviral vector. In some embodiments, the viral vector is a lentiviral vector. In some aspects, the lentiviral vector is derived from HIV-1.

Provided herein is an engineered cell containing the vector according to any one of the embodiments described above. Provided herein is an engineered cell containing the binding molecule or the TCR or antigen-binding fragment thereof according to any one of the embodiments described above. In some embodiments, the binding molecule or TCR or antigen-binding fragment thereof is heterologous to the cell.

Provided herein is an engineered cell containing a heterologous TCR or antigen-binding fragment thereof that binds to or recognizes a peptide epitope of human papillomavirus (HPV) 16 E6 in the context of an MHC molecule, wherein the TCR or antigen-binding fragment thereof does not bind to or recognize the epitope E6(29-38) containing the amino acid sequence TIHDIILECV (SEQ ID NO: 233). In some aspects, the TCR or antigen-binding fragment thereof that binds to or recognizes a peptide epitope of human papillomavirus (HPV) 16 E6 in the context of an MHC molecule is or contains the sequence set forth in SEQ ID NO: 232 or SEQ ID NO: 234.

Provided herein is an engineered cell containing a heterologous TCR or antigen-binding fragment thereof that binds to or recognizes a peptide epitope of human papillomavirus (HPV) 16 E7 in the context of an MHC molecule. In some embodiments, the peptide derived from HPV16 E7 is or contains the sequence set forth in any of SEQ ID NOs: 235-239. In some aspects, the peptide derived from HPV16 E7 is or contains the sequence set forth in SEQ ID NO: 236.

In some embodiments, the TCR or antigen-binding fragment thereof is a TCR or antigen-binding fragment thereof according to any one of the embodiments described above. In some aspects, the peptide derived from HPV16 E7 is or contains the sequence set forth in SEQ ID NO:235. In some embodiments, the TCR or antigen-binding fragment thereof is a TCR or antigen-binding fragment thereof according to any one of the embodiments described above.

In some of any such embodiments, the engineered cell is a T cell. In some embodiments, the T cell is CD8+. In some aspects, the T cell is CD4+.

In some embodiments, the engineered cell is a cell line. In some embodiments, the engineered cell is a primary cell obtained from a subject. In some embodiments, the subject is a mammalian subject. In some embodiments, the subject is a human.

In some embodiments, the provided engineered cells contain a genetic disruption of a T cell receptor alpha constant (TRAC) gene and/or a T cell receptor beta constant (TRBC) gene. In some embodiments, the TRBC gene is one or both of a T cell receptor beta constant 1 (TRBC1) or T cell receptor beta constant 2 (TRBC2) gene.

Also provided herein are methods for producing any of the engineered cells described herein, that includes introducing any of the vectors described herein into a cell in vitro or ex vivo. In some embodiments, the vector is a viral vector and the introducing is carried out by transduction.

In some embodiments, the methods provided herein include introducing into the cell one or more agent, wherein each of the one or more agent is independently capable of inducing a genetic disruption of a T cell receptor alpha constant (TRAC) gene and/or a T cell receptor beta constant (TRBC) gene. In some embodiments, the one or more agent capable of inducing a genetic disruption comprises a DNA binding protein or DNA-binding nucleic acid that specifically binds to or hybridizes to the target site. In some embodiments, the one or more agent capable of inducing a genetic disruption comprises (a) a fusion protein containing a DNA-targeting protein and a nuclease or (b) an RNA-guided nuclease. In some embodiments, the DNA-targeting protein or RNA-guided nuclease comprises a zinc finger protein (ZFP), a TAL protein, or a clustered regularly interspaced short palindromic nucleic acid (CRISPR)-associated nuclease (Cas) specific for a target site within the TRAC and/or TRBC gene. In some embodiments, the one or more agent comprises a zinc finger nuclease (ZFN), a TAL-effector nuclease (TALEN), or and a CRISPR-Cas9 combination that specifically binds to, recognizes, or hybridizes to the target site. In some embodiments, the each of the one or more agent comprises a guide RNA (gRNA) having a targeting domain that is complementary to the at least one target site.

In some embodiments, the one or more agent is introduced as a ribonucleoprotein (RNP) complex containing the gRNA and a Cas9 protein. In some embodiments, the RNP is introduced via electroporation, particle gun, calcium phosphate transfection, cell compression or squeezing. In some embodiments, the RNP is introduced via electroporation.

In some embodiments, the one or more agent is introduced as one or more polynucleotide encoding the gRNA and/or a Cas9 protein.

Provided herein is a method for producing a cell according to any one of the embodiments described above, including transducing a cell in vitro or ex vivo with a vector according to any one of the embodiments described above.

Provided herein is a composition containing the binding molecule or the TCR or antigen-binding fragment thereof according to any one of the embodiments described above, or the engineered cell according to any one of the embodiments described above. Provided herein is a composition containing an engineered CD8+ cell according to any one of the embodiments described above and an engineered CD4+ cell according to any one of the embodiments described above.

In some embodiments, the TCR or antigen-binding fragment thereof binds to or recognizes a peptide epitope of HPV 16 in the context of an MHC molecule that is at least partially CD8-independent.

In some aspects, the CD8+ cell and CD4+ cell are engineered with the same TCR or antigen-binding fragment thereof and/or are each engineered with a TCR or antigen-binding fragment thereof that binds to or recognizes the same peptide epitope of HPV 16 in the context of an MHC molecule.

In some aspects, also provided are compositions according to any one of the embodiments described above, further containing a pharmaceutically acceptable excipient.

Also provided herein are methods of treatment. Provided herein is a method of treatment including administering the engineered cell according to any one of the embodiments described above to a subject having a disease or disorder associated with HPV. Provided herein is a method of treatment including administering the composition according to any one of the embodiments described above to a subject having a disease or disorder associated with HPV. In some aspect, the disease or disorder is associated with HPV16. In some instances, the disease or disorder is cancer. In some embodiments, the subject is a human.

Also provided herein are compositions, such as any of the compositions described herein, for use in treating a disease or disorder associated with HPV.

Also provided herein are uses of compositions, such as any of the compositions provided herein, for the manufacture of a medicament for treating a disease or disorder associated with HPV. In some embodiments, the disease or disorder is associated with HPV16. In some embodiments, the disease or disorder is cancer. In some embodiments, the subject is a human.

DETAILED DESCRIPTION

Figure 1:
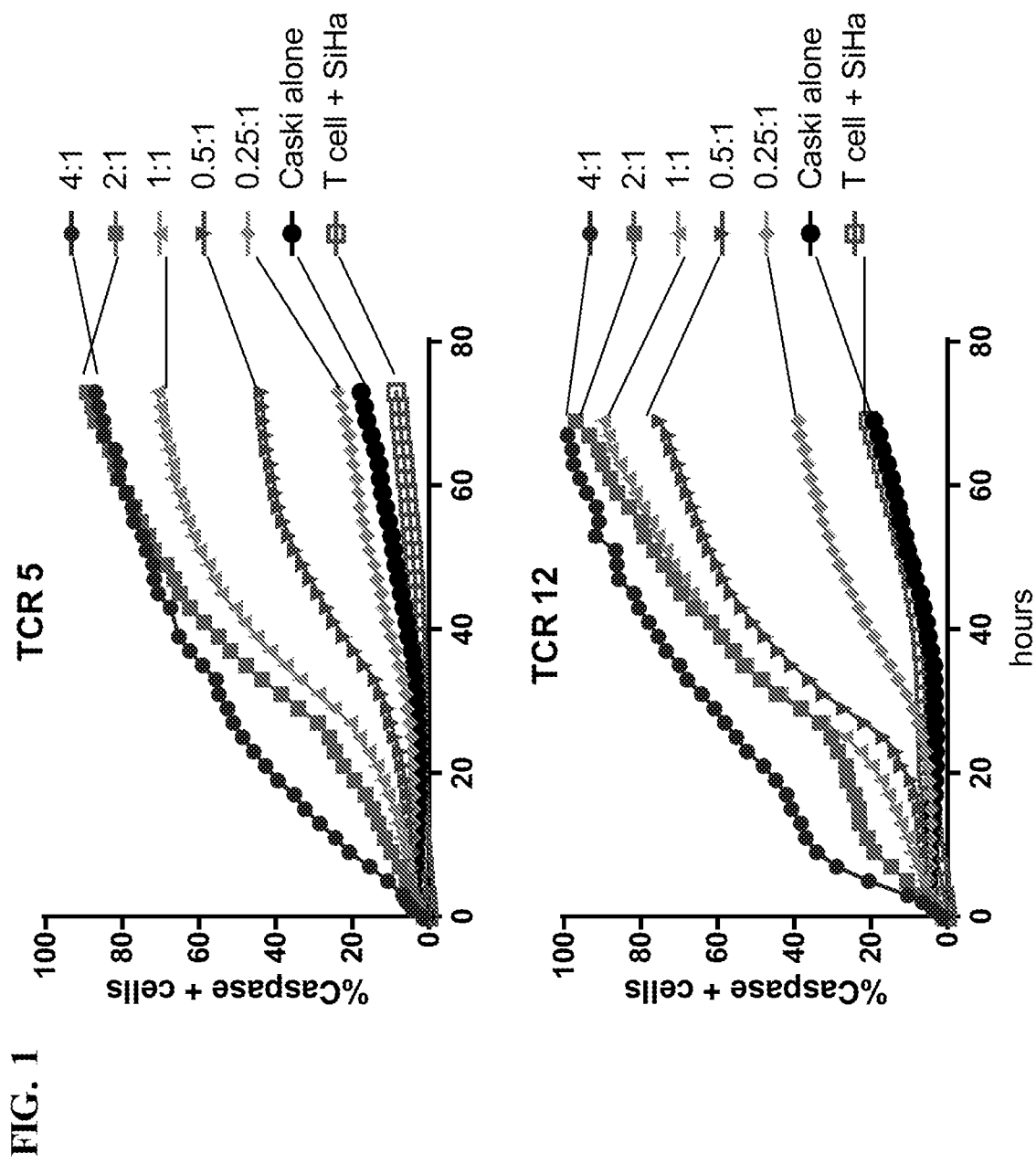
FIG. 1 shows lytic activity of monoclonal T cell lines expressing exemplary TCRs incubated with SiHa cells or Caski target cells based on the percent of caspase positive target cells at various assessed time points. Specifically, results are shown for T cell lines expressing the modified version of TCR 5 and the modified version of TCR 12.

I. T Cell Receptors and Other HPV-Specific Binding Molecules

Provided herein are binding molecules, such as those that bind or recognize a peptide epitope of human papillomavirus (HPV) 16, e.g., a peptide epitope of HPV 16 E6 or E7, in the context of an MHC molecule. Such binding molecules include T cell receptors (TCRs) and antigen-binding fragments thereof and antibodies and antigen binding fragments thereof that exhibit antigenic specificity for binding or recognizing a peptide epitope of HPV 16 E6 or HPV 16 E7. Also provided in some embodiments are nucleic acid molecules encoding the binding molecules, engineered cells containing the binding molecules, compositions and methods of treatment involving administering such binding molecules, engineered cells or compositions.

HPV is a causative organism in most cases of cervical cancer and has been implicated in anal, vaginal, vulvar, penile, and oropharyngeal cancers, and other cancers. Generally, the HPV genome contains an early region containing six open reading frames (E1, E2, E4, E5, E6 and E7), which encode proteins involved in cell transformation and replication, and a late region containing two open reading frames (L1 and L2), which encode proteins of the viral capsid. In general, E6 and E7 are oncogenes that can affect cell cycle regulation and contribute to the formation of cancers. For instance, the E6 gene product can cause p53 degradation and the E7 gene product can cause retinoblastoma (Rb) inactivation.

In some aspects, a provided HPV 16 binding molecule, including a TCR or antigen binding fragment thereof or an anti-HPV 16 antibody, e.g., antibody fragments thereof, and proteins such as chimeric molecules containing one or more of the foregoing, such as the chimeric receptors, e.g., TCR-like CARs, and/or engineered cells expressing the TCRs or CARs, bind to a peptide epitope derived from HPV16 E6 protein. In some aspects, a provided HPV 16 binding molecule, including a TCR or antigen binding fragments thereof or anti-HPV 16 antibody, e.g., antibody fragments and proteins containing the same, such as the chimeric receptors, e.g., TCR-like CARs, and/or engineered cells expressing the TCRs or CARs, binds to a peptide epitope derived from HPV16 E7 protein.

In some aspects, the binding molecule recognizes or binds HPV 16 E6 or E7 epitopes in the context of an MHC molecule, such as an MHC Class I molecule. In some aspects, the MHC Class I molecule is an HLA-A2 molecule, including any one or more subtypes thereof, e.g. HLA-A*0201, *0202, *0203, *0206, or *0207. In some cases, there can be differences in the frequency of subtypes between different populations. For example, in some embodiments, more than 95% of the HLA-A2 positive Caucasian population is HLA-A*0201, whereas in the Chinese population the frequency has been reported to be approximately 23% HLA-A*0201, 45% HLA-A*0207, 8% HLA-A*0206 and 23% HLA-A*0203. In some embodiments, the MHC molecule is HLA-A*0201.

In some embodiments, the TCR or antigen-binding fragment thereof recognizes or binds to an epitope or region of HPV16 E6 or HPV 16 E7, such as a peptide epitope containing an amino acid sequence set forth in any of SEQ ID NOs: 232-239, and as shown below in Table 1.

TABLE 1

HPV-16 Epitopes

| Epitope Description | Epitope Name | SEQ ID NO. |
|---|---|---|
| KLPQLCTEL | E6(18-26) | 232 |
| TIHDIILECV | E6(29-38) | 233 |
| FAFRDLCIV | E6(52-60) | 234 |
| TLGIVCPI | E7(86-93) | 235 |
| YMLDLQPET | E7(11-19) | 236 |
| GTLGIVCPI | E7(85-93) | 237 |

TABLE 1-continued

HPV-16 Epitopes

| Epitope Description | Epitope Name | SEQ ID NO. |
|---|---|---|
| LLMGTLGIV | E7(82-90) | 238 |
| TLHEYMLDL | E7(7-15) | 239 |

In some embodiments, the binding molecule, e.g., TCR or antigen-binding fragment thereof or antibody or antigen-binding fragment thereof, is isolated or purified or is recombinant. In some aspects, the binding molecule, e.g., TCR or antigen-binding fragment thereof or antibody or antigen-binding fragment thereof, is human. In some embodiments, the binding molecule is monoclonal. In some aspects, the binding molecule is a single chain. In other embodiments, the binding molecule contains two chains. In some embodiments, the binding molecule, e.g., TCR or antigen-binding fragment thereof or antibody or antigen-binding fragment thereof, is expressed on the surface of a cell.

In some aspects, the provided binding molecules have one or more specified functional features, such as binding properties, including binding to particular epitopes, and/or particular binding affinities as described.

A. T Cell Receptors (TCRs)

In some embodiments, the binding molecule that recognizes or binds an epitope or region of HPV 16 is a T cell receptor (TCR) or an antigen-binding fragment thereof.

In some embodiments, a "T cell receptor" or "TCR" is a molecule that contains a variable α and β chains (also known as TCRα and TCRβ, respectively) or a variable γ and δ chains (also known as TCRγ and TCRδ, respectively), or antigen-binding portions thereof, and which is capable of specifically binding to a peptide bound to an MHC molecule. In some embodiments, the TCR is in the αβ form. Typically, TCRs that exist in αβ and γδ forms are generally structurally similar, but T cells expressing them may have distinct anatomical locations or functions. A TCR can be found on the surface of a cell or in soluble form. Generally, a TCR is found on the surface of T cells (or T lymphocytes) where it is generally responsible for recognizing antigens bound to major histocompatibility complex (MHC) molecules.

Unless otherwise stated, the term "TCR" should be understood to encompass full TCRs as well as antigen-binding portions or antigen-binding fragments thereof. In some embodiments, the TCR is an intact or full-length TCR, such as a TCR containing the α chain and β chain. In some embodiments, the TCR is an antigen-binding portion that is less than a full-length TCR but that binds to a specific peptide bound in an MHC molecule, such as binds to an MHC-peptide complex. In some cases, an antigen-binding portion or fragment of a TCR can contain only a portion of the structural domains of a full-length or intact TCR, but yet is able to bind the peptide epitope, such as MHC-peptide complex, to which the full TCR binds. In some cases, an antigen-binding portion contains the variable domains of a TCR, such as variable α ($V_\alpha$) chain and variable β ($V_\beta$) chain of a TCR, or antigen-binding fragments thereof sufficient to form a binding site for binding to a specific MHC-peptide complex.

In some embodiments, the variable domains of the TCR contain complementarity determining regions (CDRs), which generally are the primary contributors to antigen recognition and binding capabilities and specificity of the peptide, MHC and/or MHC-peptide complex. In some embodiments, a CDR of a TCR or combination thereof forms all or substantially all of the antigen-binding site of a given TCR molecule. The various CDRs within a variable region of a TCR chain generally are separated by framework regions (FRs), which generally display less variability among TCR molecules as compared to the CDRs (see, e.g., Jores et al., Proc. Nat'l Acad. Sci. U.S.A. 87:9138, 1990; Chothia et al., EMBO J. 7:3745, 1988; see also Lefranc et al., Dev. Comp. Immunol. 27:55, 2003). In some embodiments, CDR3 is the main CDR responsible for antigen binding or specificity, or is the most important among the three CDRs on a given TCR variable region for antigen recognition, and/or for interaction with the processed peptide portion of the peptide-MHC complex. In some contexts, the CDR1 of the alpha chain can interact with the N-terminal part of certain antigenic peptides. In some contexts, CDR1 of the beta chain can interact with the C-terminal part of the peptide. In some contexts, CDR2 contributes most strongly to or is the primary CDR responsible for the interaction with or recognition of the MHC portion of the MHC-peptide complex. In some embodiments, the variable region of the β-chain can contain a further hypervariable region (CDR4 or HVR4), which generally is involved in superantigen binding and not antigen recognition (Kotb (1995) Clinical Microbiology Reviews, 8:411-426).

In some embodiments, the α-chain and/or β-chain of a TCR also can contain a constant domain, a transmembrane domain and/or a short cytoplasmic tail (see, e.g., Janeway et al., Immunobiology: The Immune System in Health and Disease, 3$^{rd}$ Ed., Current Biology Publications, p. 4:33, 1997). In some aspects, each chain (e.g. alpha or beta) of the TCR can possess one N-terminal immunoglobulin variable domain, one immunoglobulin constant domain, a transmembrane region, and a short cytoplasmic tail at the C-terminal end. In some embodiments, a TCR, for example via the cytoplasmic tail, is associated with invariant proteins of the CD3 complex involved in mediating signal transduction. In some cases, the structure allows the TCR to associate with other molecules like CD3 and subunits thereof. For example, a TCR containing constant domains with a transmembrane region may anchor the protein in the cell membrane and associate with invariant subunits of the CD3 signaling apparatus or complex. The intracellular tails of CD3 signaling subunits (e.g. CD3γ, CD3δ, CD3ε and CD3ζ chains) contain one or more immunoreceptor tyrosine-based activation motif or ITAM and generally are involved in the signaling capacity of the TCR complex.

It is within the level of a skilled artisan to determine or identify the various domains or regions of a TCR. In some cases, the exact locus of a domain or region can vary depending on the particular structural or homology modeling or other features used to describe a particular domain. It is understood that reference to amino acids, including to a specific sequence set forth as a SEQ ID NO used to describe domain organization of a TCR are for illustrative purposes and are not meant to limit the scope of the embodiments provided. In some cases, the specific domain (e.g. variable or constant) can be several amino acids (such as one, two, three or four) longer or shorter. In some aspects, residues of a TCR are known or can be identified according to the International Immunogenetics Information System (IMGT) numbering system (see e.g. www.imgt.org; see also, Lefranc et al. (2003) Developmental and Comparative Immunology, 2&; 55-77; and The T Cell Factsbook 2nd Edition, Lefranc and LeFranc Academic Press 2001). Using this system, the CDR1 sequences within a TCR Vα chains and/or Vβ chain correspond to the amino acids present between residue numbers 27-38, inclusive, the CDR2 sequences within a TCR Vα chain and/or Vβ chain correspond to the amino acids present between residue numbers 56-65, inclusive, and the CDR3 sequences within a TCR Vα chain and/or Vβ chain correspond to the amino acids present between residue numbers 105-117, inclusive.

In some embodiments, the α chain and β chain of a TCR each further contain a constant domain. In some embodiments, the α chain constant domain (Cα) and β chain constant domain (Cβ) individually are mammalian, such as is a human or murine constant domain. In some embodiments, the constant domain is adjacent to the cell membrane. For example, in some cases, the extracellular portion of the TCR formed by the two chains contains two membrane-proximal constant domains, and two membrane-distal variable domains, which variable domains each contain CDRs.

In some embodiments, each of the Cα and Cβ domains is human. In some embodiments, the Cα is encoded by the TRAC gene (IMGT nomenclature) or is a variant thereof. In some embodiments, the Cα has or comprises the sequence of amino acids set forth in SEQ ID NO: 213 or 220 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 213 or 220. In some embodiments, the Cα has or comprises the sequence of amino acids set forth in SEQ ID NO: 212, 215 or 217 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 212, 215 or 217. In some embodiments, the Cα has or comprises the sequence of amino acids set forth in any of SEQ ID NOS: 212, 213, 215, 217, 220, or 524. In some embodiments, the Cβ is encoded by TRBC1 or TRBC2 genes (IMGT nomenclature) or is a variant thereof. In some embodiments, the Cβ has or comprises the sequence of amino acids set forth in SEQ ID NO:214, 216, 631, or 889 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 214, 216, 631, or 889. In some embodiments, the Cβ has or comprises the sequence of amino acids set forth in SEQ ID NO: 214, 216, 631, or 889.

In some embodiments, any of the provided TCRs or antigen-binding fragments thereof can be a human/mouse chimeric TCR. In some cases, the TCR or antigen-binding fragment thereof comprises an alpha chain and/or a beta chain comprising a mouse constant region. In some embodiments, the Cα is a mouse constant region that is or comprises the sequence of amino acids set forth in SEQ ID NO: 262, 317, 833, 1012, 1014, 1015, 1017 or 1018 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 262, 317, 833, 1012, 1014, 1015, 1017 or 1018. In some embodiments, the Cα is or comprises the sequence of amino acids set forth in SEQ ID NO: 262, 317, 833, 1012, 1014, 1015, 1017 or 1018. In some embodiments, the Cβ is a mouse constant region that is or comprises the sequence of amino acids set forth in SEQ ID NO: 263, 109, 1013 or 1016 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 263, 109, 1013 or 1016. In some embodiments, the Cβ is or comprises the sequence of amino acids set forth in SEQ ID NO: 263, 109, 1013 or 1016. In some embodiments, the Cα is or comprises the sequence of amino acids set forth in SEQ ID NO: 262 or 1014 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 262 or 1014 and/or the Cβ is or comprises the sequence of amino acids set forth in SEQ ID NO: 263 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 263. In some embodiments, the Cα and/or Cβ is or comprises any Cα and/or Cβ described in WO 2015/184228, WO 2015/009604 and WO 2015/009606.

In some embodiments, the TCR or antigen-binding fragment thereof herein comprises a variant of an alpha chain and/or a beta chain, e.g., an alpha and/or beta chain that comprises a mouse constant region. In some embodiments, the variant comprises the amino acid sequence of any of the TCRs described herein with one, two, three, or four or more amino acid substitution(s) in the constant region of the alpha or beta chain. In some embodiments, the variant comprises the amino acid sequence of any of the constant regions described herein with one, two, three, or four or more amino acid substitution(s) in the constant region. In some embodiments, the TCRs (or functional portions thereof) comprising the substituted amino acid sequence(s) advantageously provide one or more of increased recognition of HPV 16 targets, increased expression by a host cell, and increased anti-tumor activity as compared to the parent TCR comprising an unsubstituted amino acid sequence.

In some embodiments, the substituted amino acid sequences of the mouse constant regions of the TCR α and β chains, SEQ ID NOs: 1015 and 1016, respectively, correspond with all or portions of the unsubstituted mouse constant region amino acid sequences SEQ ID NOs: 1014 and 263, respectively, with SEQ ID NO: 1015 having one, two, three, or four amino acid substitution(s) when compared to SEQ ID NO: 1014 and SEQ ID NO: 1016 having one amino acid substitution when compared to SEQ ID NO: 263. In some embodiments, a variant of a TCR comprises the amino acid sequences of (a) SEQ ID NO: 1015 (constant region of alpha chain), wherein (i) X at position 48 is Thr or Cys; (ii) X at position 112 is Ser, Gly, Ala, Val, Leu, Be, Pro, Phe, Met, or Trp; (iii) X at position 114 is Met, Gly, Ala, Val, Leu, Ile, Pro, Phe, Met, or Trp; and (iv) X at position 115 is Gly, Ala, Val, Leu, Be, Pro, Phe, Met, or Trp; and (b) SEQ ID NO: 1016 (constant region of beta chain), wherein X at position 56 is Ser or Cys. In some embodiments, the Cα is or comprises the sequence of amino acids set forth in SEQ ID NO: 1015 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1015 and/or the Cβ is or comprises the sequence of amino acids set forth in SEQ ID NO: 1016 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1016.

In some embodiments, the TCR may be a heterodimer of two chains α and β that are linked, such as by a disulfide bond or disulfide bonds. In some embodiments, the constant domain of the TCR may contain short connecting sequences in which a cysteine residue forms a disulfide bond, thereby linking the two chains of the TCR. In some embodiments, a TCR may have an additional cysteine residue in each of the α and β chains, such that the TCR contains two disulfide bonds in the constant domains. In some embodiments, each of the constant and variable domains contains disulfide bonds formed by cysteine residues.

In some embodiments, the TCR can contain an introduced disulfide bond or bonds. In some embodiments, the native disulfide bonds are not present. In some embodiments, the one or more of the native cysteines (e.g. in the constant domain of the α chain and β chain) that form a native interchain disulfide bond are substituted to another residue, such as to a serine or alanine. In some embodiments, an introduced disulfide bond can be formed by mutating non-cysteine residues on the alpha and beta chains, such as in the constant domain of the α chain and β chain, to cysteine. Opposing cysteines in the TCR α and β chains in provide a disulfide bond that links the constant regions of TCR α and β chains of the substituted TCR to one another and which is not present in a TCR comprising the unsubstituted human constant region or the unsubstituted mouse constant region. In some embodiments, the presence of non-native cysteine residues (e.g. resulting in one or more non-native disulfide bonds) in a recombinant TCR can favor production of the desired recombinant TCR in a cell in which it is introduced over expression of a mismatched TCR pair containing a native TCR chain.

Exemplary non-native disulfide bonds of a TCR are described in published International PCT No. WO2006/000830 and WO2006/037960. In some embodiments, cysteines can be introduced or substituted at a residue corresponding to Thr48 of the Cα chain and Ser57 of the Cβ chain, at residue Thr45 of the Cα chain and Ser77 of the Cβ chain, at residue Tyr10 of the Cα chain and Ser17 of the Cβ chain, at residue Thr45 of the Cα chain and Asp59 of the Cβ chain and/or at residue Ser15 of the Cα chain and Glu15 of the Cβ chain with reference to numbering of a Cα set forth in any of SEQ ID NOS: 212, 213, 217, or 524, or Cβ set forth in SEQ ID NO: 214 or 216. In some embodiments, the variant of the TCR is a cysteine-substituted, chimeric TCR in which one or both of the native Thr48 of SEQ ID NO: 1014 and the native Ser56 of SEQ ID NO: 263 is substituted with Cys. In some embodiments, the Cα is or comprises the sequence of amino acids set forth in SEQ ID NO: 1017 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1017 and/or the Cβ is or comprises the sequence of amino acids set forth in SEQ ID NO: 1016 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1013.

In some embodiments, any of the provided cysteine mutations can be made at a corresponding position in another sequence, for example, in the mouse Cα and Cβ sequences described above. The term "corresponding" with reference to positions of a protein, such as recitation that amino acid positions "correspond to" amino acid positions in a disclosed sequence, such as set forth in the Sequence listing, refers to amino acid positions identified upon alignment with the disclosed sequence based on structural sequence alignment or using a standard alignment algorithm, such as the GAP algorithm. For example, corresponding residues can be determined by alignment of a reference sequence with the Cα sequence set forth in any of SEQ ID NOS: 212, 213, 215, 217, 220, or 524, or the Cβ sequence set forth in SEQ ID NO: 214, 216, 631, or 889, by structural alignment methods as described herein. By aligning the sequences, one skilled in the art can identify corresponding residues, for example, using conserved and identical amino acid residues as guides.

In some embodiments, the variant includes substitutions of one, two, or three amino acids in the transmembrane (TM) domain of the constant region of one or both of the α and β chains with a hydrophobic amino acid to provide a hydrophobic amino acid-substituted TCR. The hydrophobic amino acid substitution(s) in the TM domain of the TCR may increase the hydrophobicity of the TM domain of the TCR as compared to a TCR that lacks the hydrophobic amino acid substitution(s) in the TM domain. In some embodiments, the variant of the TCR comprises one, two, or three of the native Ser 112, Met 114, and Gly 115 of SEQ ID NO: 1014 may, independently, be substituted with Gly, Ala, Val, Leu, He, Pro, Phe, Met, or Trp; for example with Leu, Ile, or Val. In some embodiments, the Cα is or comprises the sequence of amino acids set forth in SEQ ID NO: 1018 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1018 and/or the Cβ is or comprises the sequence of amino acids set forth in SEQ ID NO: 263 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 263.

In some embodiments, the variant includes substitutions cysteine substitutions in the constant region of one or both of the α and β chains in combination with the substitution(s) of one, two, or three amino acids in the transmembrane (TM) domain of the constant region of one or both of the α and β chains with a hydrophobic amino acid. In some embodiments, the variant has the native Thr48 of SEQ ID NO: 1014 substituted with Cys; one, two, or three of the native Ser 112, Met 114, and Gly 115 of SEQ ID NO: 1014, independently, substituted with Gly, Ala, Val, Leu, Ile, Pro, Phe, Met, or Trp; for example with Leu, Ile, or Val; and the native Ser56 of SEQ ID NO: 19 substituted with Cys. In some embodiments, the Cα is or comprises the sequence of amino acids set forth in SEQ ID NO: 833 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 833 and/or the Cβ is or comprises the sequence of amino acids set forth in SEQ ID NO: 1013 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1013.

Exemplary sequences (e.g. CDRs, $V_\alpha$ and/or $V_\beta$ and constant region sequences) of provided TCRs are described below.

In some embodiments, the TCR is a full-length TCR. In some embodiments, the TCR is an antigen-binding portion. In some embodiments, the TCR is a dimeric TCR (dTCR). In some embodiments, the TCR is a single-chain TCR (sc-TCR). A TCR may be cell-bound or in soluble form. In some embodiments, the TCR is in cell-bound form expressed on the surface of a cell.

In some embodiments a dTCR contains a first polypeptide wherein a sequence corresponding to a provided TCR α chain variable region sequence is fused to the N terminus of a sequence corresponding to a TCR α chain constant region extracellular sequence, and a second polypeptide wherein a sequence corresponding to a provided TCR β chain variable region sequence is fused to the N terminus a sequence corresponding to a TCR β chain constant region extracellular sequence, the first and second polypeptides being linked by a disulfide bond. In some embodiments, the bond can correspond to the native interchain disulfide bond present in native dimeric αβ TCRs. In some embodiments, the interchain disulfide bonds are not present in a native TCR. For example, in some embodiments, one or more cysteines can be incorporated into the constant region extracellular sequences of dTCR polypeptide pair. In some cases, both a native and a non-native disulfide bond may be desirable. In some embodiments, the TCR contains a transmembrane sequence to anchor to the membrane.

In some embodiments, a dTCR contains a provided TCR α chain containing a variable α domain, a constant α domain and a first dimerization motif attached to the C-terminus of the constant α domain, and a provided TCR β chain comprising a variable β domain, a constant β domain and a first dimerization motif attached to the C-terminus of the constant β domain, wherein the first and second dimerization motifs easily interact to form a covalent bond between an amino acid in the first dimerization motif and an amino acid in the second dimerization motif linking the TCR α chain and TCR β chain together.

In some embodiments, the TCR is a scTCR, which is a single amino acid strand containing an α chain and a β chain that is able to bind to MHC-peptide complexes. Typically, a scTCR can be generated using methods known to those of skill in the art, See e.g., International published PCT Nos. WO 96/13593, WO 96/18105, WO99/18129, WO 04/033685, WO2006/037960, WO2011/044186; U.S. Pat. No. 7,569,664; and Schlueter, C. J. et al. J. Mol. Biol. 256, 859 (1996).

In some embodiments, a scTCR contains a first segment constituted by an amino acid sequence corresponding to a sequence of a provided TCR α chain variable region, a second segment constituted by an amino acid sequence corresponding to a provided TCR β chain variable region sequence fused to the N terminus of an amino acid sequence corresponding to a TCR β chain constant domain extracellular sequence, and a linker sequence linking the C terminus of the first segment to the N terminus of the second segment.

In some embodiments, a scTCR contains a first segment constituted by an amino acid sequence corresponding to a provided TCR β chain variable region, a second segment constituted by an amino acid sequence corresponding to a provided TCR α chain variable region sequence fused to the N terminus of an amino acid sequence corresponding to a TCR α chain constant domain extracellular sequence, and a linker sequence linking the C terminus of the first segment to the N terminus of the second segment.

In some embodiments, a scTCR contains a first segment constituted by a provided α chain variable region sequence fused to the N terminus of an α chain extracellular constant domain sequence, and a second segment constituted by a provided β chain variable region sequence fused to the N terminus of a sequence β chain extracellular constant and transmembrane sequence, and, optionally, a linker sequence linking the C terminus of the first segment to the N terminus of the second segment.

In some embodiments, a scTCR contains a first segment constituted by a provided TCR β chain variable region sequence fused to the N terminus of a β chain extracellular constant domain sequence, and a second segment constituted by a provided α chain variable region sequence fused to the N terminus of a sequence α chain extracellular constant and transmembrane sequence, and, optionally, a linker sequence linking the C terminus of the first segment to the N terminus of the second segment.

In some embodiments, for the scTCR to bind an MHC-peptide complex, the α and β chains must be paired so that the variable region sequences thereof are orientated for such binding. Various methods of promoting pairing of an α and β in a scTCR are well known in the art. In some embodiments, a linker sequence is included that links the α and β chains to form the single polypeptide strand. In some embodiments, the linker should have sufficient length to span the distance between the C terminus of the α chain and the N terminus of the β chain, or vice versa, while also ensuring that the linker length is not so long so that it blocks or reduces bonding of the scTCR to the target peptide-MHC complex.

In some embodiments, the linker of a scTCRs that links the first and second TCR segments can be any linker capable of forming a single polypeptide strand, while retaining TCR binding specificity. In some embodiments, the linker sequence may, for example, have the formula -P-AA-P-, wherein P is proline and AA represents an amino acid sequence wherein the amino acids are glycine and serine. In some embodiments, the first and second segments are paired so that the variable region sequences thereof are orientated for such binding. Hence, in some cases, the linker has a sufficient length to span the distance between the C terminus of the first segment and the N terminus of the second segment, or vice versa, but is not too long to block or reduces bonding of the scTCR to the target ligand. In some embodiments, the linker can contain from or from about 10 to 45 amino acids, such as 10 to 30 amino acids or 26 to 41 amino acids residues, for example 29, 30, 31 or 32 amino acids. In some embodiments, the linker has the formula -PGGG-(SGGGG)$_n$-P-, wherein n is 5 or 6 and P is proline, G is glycine and S is serine (SEQ ID NO: 266). In some embodiments, the linker has the sequence GSADDAKK-DAAKKDGKS (SEQ ID NO: 267).

In some embodiments, a scTCR contains a disulfide bond between residues of the single amino acid strand, which, in some cases, can promote stability of the pairing between the α and β regions of the single chain molecule (see e.g. U.S. Pat. No. 7,569,664). In some embodiments, the scTCR contains a covalent disulfide bond linking a residue of the immunoglobulin region of the constant domain of the α chain to a residue of the immunoglobulin region of the constant domain of the β chain of the single chain molecule. In some embodiments, the disulfide bond corresponds to the native disulfide bond present in a native dTCR. In some embodiments, the disulfide bond in a native TCR is not present. In some embodiments, the disulfide bond is an introduced non-native disulfide bond, for example, by incorporating one or more cysteines into the constant region extracellular sequences of the first and second chain regions of the scTCR polypeptide. Exemplary cysteine mutations include any as described above. In some cases, both a native and a non-native disulfide bond may be present.

In some embodiments, a scTCR is a non-disulfide linked truncated TCR in which heterologous leucine zippers fused to the C-termini thereof facilitate chain association (see e.g. International published PCT No. WO99/60120). In some embodiments, a scTCR contain a TCRα variable domain covalently linked to a TCRβ variable domain via a peptide linker (see e.g., International published PCT No. WO99/18129).

In some embodiments, any of the provided TCRs, including a dTCR or scTCR, can be linked to signaling domains that yield an active TCR on the surface of a T cell. In some embodiments, the TCR is expressed on the surface of cells. In some embodiments, the TCR does contain a sequence corresponding to a transmembrane sequence. In some embodiments, the transmembrane domain is positively charged. In some embodiments, the transmembrane domain can be a Cα or Cβ transmembrane domain. In some embodiments, the transmembrane domain can be from a non-TCR origin, for example, a transmembrane region from CD3z, CD28 or B7.1. In some embodiments, the TCR does contain a sequence corresponding to cytoplasmic sequences. In some embodiments, the TCR contains a CD3z signaling domain. In some embodiments, the TCR is capable of forming a TCR complex with CD3.

In some embodiments, the TCR is a soluble TCR. In some embodiments, the soluble TCR has a structure as described in WO99/60120 or WO 03/020763. In some embodiments, the TCR does not contain a sequence corresponding to the transmembrane sequence, for example, to permit membrane anchoring into the cell in which it is expressed. In some embodiments, the TCR does not contain a sequence corresponding to cytoplasmic sequences.

1. Exemplary TCRs

In some embodiments, among the provided -TCRs or antigen-binding fragment thereof that bind or recognize a peptide epitope of HPV 16 in the context of an MHC (e.g. a peptide epitope of HPV 16 E6 or a peptide epitope of HPV 16 E7) are TCRs or antigen-binding fragments thereof that contain any of the alpha and/or beta chain variable ($V_\alpha$ or $V_\beta$) region sequences as described, individually, or a sufficient antigen-binding portion of such chain(s). In some embodiments, the provided anti-HPV 16 TCR or antigen-binding fragment thereof (e.g. anti-HPV 16 E6 or anti-HPV 16 E7 TCRs) contains a $V_\alpha$ region sequence or sufficient antigen-binding portion thereof that contains a CDR-1, CDR-2 and/or CDR-3 as described. In some embodiments, the provided anti-HPV 16 TCR or antigen-binding fragment thereof (e.g., anti-HPV 16 E6 or anti-HPV 16 E7 TCRs) contains a $V_\beta$ region sequence or sufficient antigen-binding portion that contains a CDR-1, CDR-2 and/or CDR-3 as described. In some embodiments, the anti-HPV 16 TCR or antigen-binding fragment thereof (e.g. anti-HPV 16 E6 or anti-HPV 16 E7 TCRs) contains a $V_\alpha$ region sequence that contains a CDR-1, CDR-2 and/or CDR-3 as described and contains a $V_\beta$ region sequence that contains a CDR-1, CDR-2 and/or CDR-3 as described. Also among the provided TCRs are those having sequences at least at or about 90, 91, 92, 93, 94, 95, 96, 97, 98, or 99% identical to such a sequence.

In some embodiments, the TCR contains a Vα region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO: 251), where $X_1$ is A, I, or V; $X_2$ is M, L, V, E or A; $X_3$ is R, L, N, or S; $X_4$ is E, V, P, T, F, I, R or A; $X_5$ is G, I, L, A, P, R, D, or H; $X_6$ is R, T, G, S, N or H; $X_7$ is G, R, A, N, or null; $X_8$ is T, G, or null; $X_9$ is null, A or G; $X_{10}$ is null or G; $X_{11}$ is null or G; $X_{12}$ is null or T; $X_{13}$ is F, Y, A, S or null; $X_{14}$ is G, Y, or N; $X_{15}$ is F, G, T, N, Q, or Y; $X_{16}$ is K, P, V, N or A; $X_{17}$ is T, L, or F; and $X_{18}$ is I, V, T, H, or N.

In some embodiments, the TCR or antigen-binding fragment thereof contains a $V_\alpha$ region containing a complementarity determining region 3 (CDR-3) comprising an amino acid sequence set forth in any of SEQ ID NOs: 138, 144, 147, 153, 159, 163, 167, 173, 175, 301, 304, 308, 478, 493, 505, 511, 523, 539, 555, 572, 588, 600, 612, 624, 638, 650, 662, 679, 694, 712, 729, 744, 762, 776, 788, 802, 818, 832, 846, 858, 870, 882, 896, 911, 926, 940, 952, 964, 976, 988, or 1002, or a sequence having at least at or about 90, 91, 92, 93, 94, 95, 96, 97, 98, or 99% identity with such a sequence. In some aspects, the TCR or antigen-binding fragment thereof contains a $V_\alpha$ region containing a CDR3 contained within the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999, or a sequence at least at or about 90, 91, 92, 93, 94, 95, 96, 97, 98, or 99% identical with such a sequence.

In some embodiments, the TCR contains a Vβ region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}$ (SEQ ID NO: 261), where $X_1$ is A or S; $X_2$ is 5, I, or V; $X_3$ is S, T, or V; $X_4$ is H, P, L, Y, T, D, or Q; $X_5$ is L, G, W, F, S, or R; $X_6$ is A, G, L, S, or T; $X_7$ is G, E, A, T, R, or null; $X_8$ is null or G; $X_9$ is null or G; $X_{10}$ is null, F, G, T, S, or A; $X_{11}$ is T, N, H, A, S, or F; $X_{12}$ is G, T, Q, D, Y, or L; $X_{13}$ is E, P, T, G or W; $X_{14}$ is L, A, Q, Y, or K; and $X_{15}$ is F, H, Y, or T.

In some instances, the TCR contains a $V_\beta$ region containing a complementarity determining region 3 (CDR-3) comprising an amino acid sequence set forth in any of SEQ ID NOs: 141, 146, 150, 156, 160, 164, 170, 174, 178, 305, 309, 486, 499, 517, 531, 548, 563, 581, 594, 606, 618, 630, 644, 656, 670, 686, 703, 721, 736, 753, 769, 782, 794, 809, 825, 840, 852, 864, 876, 888, 902, 919, 932, 946, 958, 970, 982, 994, or 1010, or a sequence having at least at or about 90, 91, 92, 93, 94, 95, 96, 97, 98, or 99% identity with such a sequence. In some embodiments, the TCR contains a $V_\beta$ region containing a CDR3 contained within the amino acid sequence set forth in any of SEQ ID NOs: 112, 114, 116, 118, 120, 122, 124, 126, 128, 296, 298, 300, 483, 498, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, or 1008 or a sequence at least at or about 90, 91, 92, 93, 94, 95, 96, 97, 98, or 99% identical with such a sequence.

In some aspects, the Vα region further contains a complementarity determining region 1 (CDR-1) comprising the amino acid sequence $X_1X_2X_3X_4X_5X_6X_7$ (SEQ ID NO: 243), where $X_1$ is T, D, N, or V; $X_2$ is I or S; $X_3$ is S, D, A, P, or M; $X_4$ is G, Q, P, or null; $X_5$ is T, S, I, or F; $X_6$ is D, Y, Q, T, or S; and $X_7$ is Y, G, N, or Q. In some embodiments, the Vα region further contains a complementarity determining region 2 (CDR-2) comprising the amino acid sequence $X_1X_2X_3X_4X_5X_6X_7X_8$ (SEQ ID NO: 247), where $X_1$ is G, Q, I, V, or M; $X_2$ is L, S, Q, Y, F, T, or G; $X_3$ is T, G, S, or F; $X_4$ is Y, S, N, I, or null; $X_5$ is null or D; $X_6$ is null, E, Q, S, M, or K; $X_7$ is S, Q, R, G, D, or N; and $X_8$ is N, E, M, T, or K.

In some embodiments, the $V_\alpha$ region contains a complementarity determining region 1 (CDR-1) comprising an amino acid sequence set forth in any of SEQ ID NOs: 136, 142, 151, 157, 161, 165, 171, 302, 306, 537, 570, 677, 692, 710, 727, 742, 760, 800, 816, 909, 938, or 1000, or a sequence having at least at or about 90, 91, 92, 93, 94, 95, 96, 97, 98, or 99% identity with such a sequence. In some aspects, the $V_\alpha$ region contains a CDR-1 contained within the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999, or a sequence having at least at or about 90, 91, 92, 93, 94, 95, 96, 97, 98, or 99% identity with such a sequence. In some embodiments, the $V_\alpha$ region contains a complementarity determining region 2 (CDR-2) comprising an amino acid sequence set forth in any of SEQ ID NOs: 137, 143, 152, 158, 162, 166, 172, 303, 307, 538, 571, 678, 693, 711, 728, 743, 761, 801, 817, 831, 833, 910, 939, or 1001, or a sequence having at least at or about 90, 91, 92, 93, 94, 95, 96, 97, 98, or 99% identity with such a sequence. In some embodiments, the $V_\alpha$ region contains a CDR-2 contained within the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999, or a sequence having at least at or about 90, 91, 92, 93, 94, 95, 96, 97, 98, or 99% identity with such a sequence.

In some aspects, the Vβ region further contains a complementarity determining region 1 (CDR-1) comprising the amino acid sequence $X_1X_2X_3X_4X_5$ (SEQ ID NO: 254), where $X_1$ is S, M, or L; $X_2$ is G, E, D, N, or Q; $X_3$ is H or V; $X_4$ is V, N, E, L, or T; and $X_5$ is S, R, N, Y, A, or M. In some embodiments, the Vβ region further contains a complementarity determining region 2 (CDR-2) comprising the amino acid sequence $X_1X_2X_3X_4X_5X_6X_7$ (SEQ ID NO: 257), where $X_1$ is F, Y, S, or A; $X_2$ is Q, Y, V, or N; $X_3$ is N, D, G, F, or Q; $X_4$ is null or G; $X_5$ is E, V, N, K, or S; $X_6$ is A, K, G, or E; and $X_7$ is Q, M, T, I, or A.

In some instances, the $V_\beta$ region contains a complementarity determining region 1 (CDR-1) comprising an amino acid sequence set forth in any of SEQ ID NOs: 139, 145, 148, 154, 168, 176, 484, 546, 561, 579, 668, 701, 719, or 751, or a sequence having at least at or about 90, 91, 92, 93, 94, 95, 96, 97, 98, or 99% identity with such a sequence. In some aspects, the $V_\beta$ region contains a CDR-1 contained within the amino acid sequence set forth in any of SEQ ID NOs: 112, 114, 116, 118, 120, 122, 124, 126, 128, 296, 298, 300, 483, 498, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, or 1008, or a sequence having at least at or about 90, 91, 92, 93, 94, 95, 96, 97, 98, or 99% identity with such a sequence. In some embodiments, the $V_\beta$ region contains a complementarity determining region 2 (CDR-2) comprising an amino acid sequence set forth in any of SEQ ID NOs: 140, 149, 155, 169, 177, 485, 547, 562, 580, 669, 702, 720, 752, 918, or 1009, or a sequence having at least at or about 90, 91, 92, 93, 94, 95, 96, 97, 98, or 99% identity with such a sequence. In some embodiments, the $V_\beta$ region contains a CDR-2 contained within the amino acid sequence set forth in any of SEQ ID NOs: 112, 114, 116, 118, 120, 122, 124, 126, 128, 296, 298, 300, 483, 498, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, or 1008, or a sequence having at least at or about 90, 91, 92, 93, 94, 95, 96, 97, 98, or 99% identity with such a sequence.

In some embodiments, the Vα region contains the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999, or an amino acid sequence that has at least 90%, 91%, 92%, 93%, 94%, 95%, 96%, 97%, 98%, or 99% sequence identity thereto. In some instances, the Vβ region contains the amino acid sequence set forth in any of SEQ ID NOs: 112, 114, 116, 118, 120, 122, 124, 126, 128, 296, 298, 300, 483, 498, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, or 1008, or an amino acid sequence that has at least 90%, 91%, 92%, 93%, 94%, 95%, 96%, 97%, 98%, or 99% sequence identity thereto. In some embodiments, the TCR contains an alpha chain comprising any of such Vα chain sequences and any of such Vβ chain sequences.

In some embodiments, the alpha chain of the TCR or antigen-binding fragment thereof further contains an alpha constant (Cα) region or portion thereof. In some aspects, the beta chain further contains a beta constant (Cβ) region or portion thereof. Thus, in some embodiments, the TCR, e.g., the HPV 16 E6 or E7 TCR or antigen-binding fragment thereof, contains an alpha chain comprising a variable alpha (Vα) region and an alpha constant (Cα) region or portion thereof and/or a beta chain comprising a variable beta (Vβ) region and a beta constant region (Cβ) or portion thereof.

In some cases, the Cα and Cβ regions are mouse constant regions. In some embodiments, the Cα region contains the amino acid sequence set forth in SEQ ID NO: 262 or 317, or a sequence of amino acids that has at least 90% sequence identity thereto, such as a sequence having at least at or about 90, 91, 92, 93, 94, 95, 96, 97, 98, or 99% identity with such a sequence. In some cases, the Cβ region contains the amino acid sequence set forth in SEQ ID NO: 263 or 109, or a sequence of amino acids that has at least 90% sequence identity thereto, such as a sequence having at least at or about 90, 91, 92, 93, 94, 95, 96, 97, 98, or 99% identity with such a sequence.

In some embodiments, the Cα and Cβ regions are human constant regions. In some such embodiments, the Cα region comprises the amino acid sequence set forth in any of SEQ ID NOs: 212, 213, 215, 217, 218, 220, or 524, or a sequence of amino acids that has at least 90% sequence identity thereto, such as a sequence having at least at or about 90, 91, 92, 93, 94, 95, 96, 97, 98, or 99% identity with such a sequence. In some aspects, the Cβ region contains the amino acid sequence set forth in SEQ ID NO: 214, 216, 631, or 889, or a sequence of amino acids that has at least 90% sequence identity thereto, such as a sequence having at least at or about 90, 91, 92, 93, 94, 95, 96, 97, 98, or 99% identity with such a sequence.

In some embodiments, the Cα and/or Cβ regions are modified, for example, by incorporation of one or more non-native cysteine residues. In some embodiments, the constant region is a modified form of a human constant region (e.g. modified compared to a Cα region set forth in any of SEQ ID NOs: 212, 213, 215, 217, 218, 220, or 524, and/or a Cβ region set forth in SEQ ID NO:214, 216, 631, or 889. In some embodiments, the modification is by introduction of cysteine at residue Thr48 of the Cα chain and/or Ser57 of the Cβ chain, at residue Thr45 of the Cα chain and/or Ser77 of the Cβ chain, at residue Tyr10 of the Cα chain and/or Ser17 of the Cβ chain, at residue Thr45 of the Cα chain and Asp59 of the Cβ chain and/or at residue Ser15 of the Cα chain and Glu15 of the Cβ chain with reference to numbering of a Cα set forth in any of SEQ ID NOS: 212, 213, 217, 218 or 524 or Cβ set forth in SEQ ID NO: 214 or 216. Corresponding residues can be identified by aligning a reference sequence to any of SEQ ID NOS: 212, 213, 217, 218 or 524 or 214 or 216. For example, Thr48 in the Cα chain aligns with or corresponds to Thr49 in the sequence set forth in SEQ ID NO: 215 or 220 and Ser57 in the Cβ chain aligns with or corresponds to Ser58 in the sequence set forth in SEQ ID NO:631 or 889. In some such embodiments, the Cα region contains a non-native cysteine at residue 48 (or at a corresponding residue, e.g. residue 49) and comprises the amino acid sequence set forth in any of SEQ ID NOs: 196, 198, 200, 201, 203, 525, or a sequence of amino acids that has at least 90% sequence identity thereto, such as a sequence having at least at or about 90, 91, 92, 93, 94, 95, 96, 97, 98, or 99% identity with such a sequence and that contains the introduced non-native cysteine residue or residues. In some aspects, the Cβ region contains a non-native cysteine at residue 57 (or at a corresponding residue, e.g. residue 58) and contains the amino acid sequence set forth in SEQ ID NO: 197, 199, 632, or 890, or a sequence of amino acids that has at least 90% sequence identity thereto, such as a sequence having at least at or about 90, 91, 92, 93, 94, 95, 96, 97, 98, or 99% identity with such a sequence and that contains the non-native cysteine residue or residues.

In some embodiments, the TCR or antigen-binding fragment thereof comprises an alpha chain comprising the sequence of amino acids set forth in SEQ ID NO: 18, 28, 38, 48, 58, 68, 78, 88, 98, 287, or 291 or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 22, 32, 42, 52, 62, 72, 82, 92, 102, 285, 289, 293, 479, 494, 512, 526, 541, 556, 574, 589, 601, 613, 625, 639, 651, 663, 681, 696, 714, 731, 746, 764, 777, 789, 804, 820, 835, 847, 859, 871, 883, 897, 913, 927, 941, 953, 965, 977, 989, or 1004 or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 19, 29, 39, 49, 59, 69, 79, 89, 99, 284, 288, 292, 474, 489, 501, 507, 519, 533, 551, 566, 584, 596, 608, 620, 634, 646, 658, 673, 688, 706, 723, 738, 756, 772, 784, 796, 812, 827, 842, 854, 866, 878, 892, 905, 922, 934, 948, 960, 972, 984, or 996, or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 23, 33, 43, 53, 63, 73, 83, 93, 103, 286, 290, 294, 480, 495, 513, 527, 542, 557, 575, 590, 602, 614, 626, 640, 652, 664, 682, 697, 715, 732, 747, 765, 778, 790, 805, 821, 836, 848, 860, 872, 884, 898, 914, 928, 942, 954, 966, 978, 990, or 1005, or a sequence of amino acids that has at least 90% sequence identity thereto, such as a sequence having at least at or about 90, 91, 92, 93, 94, 95, 96, 97, 98, or 99% identity with such a sequence.

In some embodiments, the alpha chain and/or beta chain of the TCR is encoded by a sequence of nucleotides comprising a signal peptide (also called a leader sequence). Non-limiting examples of such a signal peptide are signal peptides that have or comprise the sequence of amino acids set forth in any of SEQ ID NOS: 180-182, 184-194, 310, 311, 487, 540, 549, 564, 573, 582, 671, 680, 695, 704, 713, 730, 745, 754, 763, 770, 803, 810, 819, 834, 903, 912, 920, 1003, or 1011. In some embodiments, the TCR or antigen-binding fragment thereof is encoded by a sequence of nucleotides that encodes: a) an alpha chain comprising the sequence of amino acids set forth in SEQ ID NO: 318, 319, 322, 323, 326, 327, 330, 331, 334, 335, 338, 339, 130, 131, 134, 135, 195, 205, 222, 242, 253, 256, 313, 314, 475, 476, 490, 491, 502, 503, 508, 509, 520, 521, 534, 535, 552, 553, 567, 568, 585, 586, 597, 598, 609, 610, 621, 622, 635, 636, 647, 648, 659, 660, 674, 675, 689, 690, 707, 708, 724, 725, 739, 740, 757, 758, 773, 774, 785, 786, 797, 798, 813, 814, 828, 829, 843, 844, 855, 856, 867, 868, 879, 880, 893, 894, 906, 907, 923, 924, 935, 936, 949, 950, 961, 962, 973, 974, 985, 986, 997, 998, or a sequence of amino acids that has at least 90% sequence identity thereto, such as a sequence having at least at or about 90, 91, 92, 93, 94, 95, 96, 97, 98, or 99% identity with such a sequence and/or b) a beta chain comprising the sequence of amino acids set forth in SEQ ID NO: 320, 321, 324, 325, 328, 329, 332, 333, 336, 337, 110, 129, 132, 133, 179, 180, 206, 221, 246, 250, 260, 312, 315, 316, 481, 482, 496, 497, 514, 515, 616, 528, 529, 543, 544, 558, 559, 576, 577, 591, 592, 603, 604, 615, 627, 628, 641, 642, 653, 654, 665, 666, 683, 684, 698, 699, 716, 717, 733, 734, 748, 749, 766, 767, 779, 780, 791, 792, 806, 807, 822, 823, 837, 838, 849, 850, 861, 862, 873, 874, 885, 886, 899, 900, 915, 916, 929, 930, 943, 944, 955, 956, 967, 968, 979, 980, 991, 992, 1006, or 1007, or a sequence of amino acids that has at least 90% sequence identity thereto, such as a sequence having at least at or about 90, 91, 92, 93, 94, 95, 96, 97, 98, or 99% identity with such a sequence. In some embodiments, the alpha chain and beta chain can be connected via a linker, such as any described elsewhere herein.

In some embodiments, the TCR or antigen-binding fragment thereof recognizes or binds to an epitope or region of HPV16 E6, such as a peptide epitope containing an amino acid sequence set forth in any of SEQ ID NOs: 232-234. In some cases, the TCR or antigen-binding fragment thereof does not recognize or bind the epitope E6(29-38) comprising the amino acid sequence TIHDIILECV (SEQ ID NO. 233). In some instances, the TCR or antigen-binding fragment thereof that recognizes or binds a peptide epitope derived from HPV16 E6 is or comprises the sequence set forth in SEQ ID NO: 232 or SEQ ID NO: 234.

In some aspects, the TCR or antigen-binding fragment recognizes or binds to an epitope or region of HPV16 E7 protein, such as a peptide epitope containing an amino acid sequence set forth in any of SEQ ID NOs: 235-239. In some embodiments, the TCR or antigen-binding fragment thereof does not recognize or bind the epitope E7(11-19) comprising the amino acid sequence YMLDLQPET (SEQ ID NO. 236). In some cases, the peptide derived from HPV16 E7 is or contains the sequence set forth in SEQ ID NO: 235.

a. HPV 16 E6(29-38)

In some cases, the TCR recognizes or binds a peptide epitope derived from HPV16 E6 that is or contains E6(29-38) TIHDIILECV (SEQ ID NO: 233). In some embodiments, the TCR recognizes or binds HPV 16 E6 (29-38) in the context of an MHC, such as an MHC class I, e.g. HLA-A2.

In some embodiments, the TCR or antigen-binding fragment thereof contains a Vα region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO: 248), where $X_1$ is A, I, or V; $X_2$ is M, L, or V; $X_3$ is R, L, or N; $X_4$ is E, V, T, P, or F; $X_5$ is G, I, L, A, or P; $X_6$ is R, T, G, or S; $X_7$ is G, R, or null; $X_8$ is T, G, or null; $X_9$ is null or A; $X_{10}$ is null or G; $X_{11}$ is null or G; $X_{12}$ is null or T; $X_{13}$ is null or S; $X_{14}$ is G, Y, or N; $X_{15}$ is F, G, or T; $X_{16}$ is K or P; $X_{17}$ is T or L; and $X_{18}$ is I, V or T.

In some embodiments, the TCR or antigen-binding fragment thereof contains a Vα region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO:1205), where $X_1$ is A, I, or V; $X_2$ is M, L, A, V, S, or E; $X_3$ is R, L, N, S, Q, K, G, or W; $X_4$ is E, V, P, T, F, A, G, N, D, or L; $X_5$ is G, I, D, L, A, P, H, N, R, T, or null; $X_6$ is G, N, R, T, M, S, P, or null; $X_7$ is G, V, D, L, Q, T, R, N, or null; $X_8$ is T, D, S, L, G, or null; $X_9$ is A, G, Q, or null; $X_{10}$ is G, or null; $X_{11}$ is G, or null; $X_{12}$ is T, or null; $X_{13}$ is S, A, T, G, or null; $X_{14}$ is G, Y, T, N, A, W, or null; $X_{15}$ is F, G, N, T, Y, D, S, R, Q, or E; $X_{16}$ is K, P, A, N, D, or Q; $X_{17}$ is L, M, I, V, or T; and $X_{18}$ is I, T, V, N, F, R, or Q.

In some embodiments, the TCR or antigen-binding fragment thereof contains a Vα region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO:1220), where $X_1$ is A, I, or V; $X_2$ is M, L, A, V, S, or E; $X_3$ is R, L, N, S, Q, K, G, or W; $X_4$ is E, V, P, T, F, A, G, N, D, or L; $X_5$ is G, I, D, L, A, P, N, R, T, or null; $X_6$ is G, N, R, T, M, S, P, or null; $X_7$ is G, V, D, L, Q, T, R, or null; $X_8$ is T, D, S, L, G, or null; $X_9$ is A, G, Q, or null; $X_{10}$ is G, or null; $X_{11}$ is G, or null; $X_{12}$ is T, or null; $X_{13}$ is S, A, T, G, or null; $X_{14}$ is G, Y, T, N, A, W, or null; $X_{15}$ is F, G, N, T, Y, D, S, R, Q, or E; $X_{16}$ is K, P, A, D, or Q; $X_{17}$ is L, M, I, V, or T; and $X_{18}$ is I, T, V, F, R, or Q.

In some embodiments, the TCR or antigen-binding fragment thereof contains a Vα region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}LT$ (SEQ ID NO: 1206), where $X_1$ is A, I, or V; $X_2$ is L, M, V, or E; $X_3$ is L, R, N, G, or S; $X_4$ is V, T, F, N, E, P, G, or L; $X_5$ is I, A, P, N, G, or T; $X_6$ is R, G, S, or T; $X_7$ is G, R, L, V, or T; $X_8$ is T, G, L, or null; $X_9$ is A, G, Q, or null; $X_{10}$ is G, or null; $X_{11}$ is G, or null; $X_{12}$ is T, or null; $X_{13}$ is S, T, or G; $X_{14}$ is Y, A, G, or N; $X_{15}$ is G, S, N, R, or E; and $X_{16}$ is K, or Q.

In some embodiments, the TCR or antigen-binding fragment thereof contains a Vα region that contains a complementarity determining region 3 (CDR-3) comprising the amino acid sequence $AMRX_4X_5X_6X_7X_8X_9X_{10}X_{11}X_{12}X_{13}X_{14}X_{15}$(SEQ ID NO:1207), where $X_4$ is E, T, A, D, or L; $X_5$ is G, A, N, or R; $X_6$ is R, G, R, T, M, or S; $X_7$ is G, V, D, L, or null; $X_8$ is T, D, or null; $X_9$ is G, or null; $X_{10}$ is S, T, G, or null; $X_{11}$ is G, Y, N, A, or W; $X_{12}$ is F, G, N, D, S, or Y; $X_{13}$ is K, D, Q; $X_{14}$ is T, L, M, or I; and $X_{15}$ is I, T, R, or Q.

In some embodiments, the TCR or antigen-binding fragment thereof contains a Vα region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}KX_{17}X_{18}$ (SEQ ID NO:1208), where $X_1$ is I, or V; $X_2$ is L, or V; $X_3$ is L, N, or R; $X_4$ is V, F, or G; $X_5$ is I, P, G, or T; $X_6$ is R, S, P, or G; $X_7$ is G, R, Q, T, or V; $X_8$ is T, G, S, or L; $X_9$ is A, G, Q, or null; $X_{10}$ is G, or null; $X_{11}$ is G, or null; $X_{12}$ is T, or null; $X_{13}$ is G, or S; $X_{14}$ is Y, or N; $X_{15}$ is G, Q, or E; $X_{17}$ is V, or L; and $X_{18}$ is I, or T.

In some embodiments, the TCR or antigen-binding fragment thereof contains a Vα region that contains a complementarity determining region 3 (CDR-3) comprising the amino acid sequence $AX_2RX_4AX_6NNDMR$ (SEQ ID NO:1221), where $X_2$ is V, or M; $X_4$ is P, or D; $X_6$ is N, or R.

In some embodiments, the Vα region contains a complementarity determining region 1 (CDR-1) comprising the amino acid sequence $X_1X_2X_3X_4X_5X_6X_7$ (SEQ ID NO: 240), where $X_1$ is T, D, or N; $X_2$ is I, or S; $X_3$ is S, D, or A; $X_4$ is G, Q, P, or null; $X_5$ is T, S, or I; $X_6$ is D, Y, or Q; and $X_7$ is Y, G, N, or Q. In some embodiments, the Vα region contains a complementarity determining region 1 (CDR-1) comprising the amino acid sequence $X_1X_2X_3X_4X_5X_6X_7$ (SEQ ID NO: 1209), where $X_1$ is T, N, D, or S; $X_2$ is 5, I, or R; $X_3$ is D, S, M, A, Y, N, or G; $X_4$ is Q, G, P, or null; $X_5$ is S, T, F, I, or N; $X_6$ is Y, D, Q, P, N, or E; and $X_7$ is G, Y, N, S, or A.

In some examples, the Vα region contains a complementarity determining region 2 (CDR-2) comprising the amino acid sequence $X_1X_2X_3X_4X_5X_6X_7X_8$ (SEQ ID NO: 244), where $X_1$ is G, Q, I, or V; $X_2$ is L, S, Q, or Y; $X_3$ is T, G, or S; $X_4$ is Y, S, or null; $X_5$ is null or D; $X_6$ is null, E, Q, or S; $X_7$ is S, Q, R, or G; and $X_8$ is N or E. In some examples, the Vα region contains a complementarity determining region 2 (CDR-2) comprising the amino acid sequence $X_1X_2X_3X_4X_5X_6X_7X_8$ (SEQ ID NO:1210), where $X_1$ is Q, G, I, V, Y, M, R, or N; $X_2$ is G, L, S, Q, Y, T, N, or V; $X_3$ is S, T, L, or K; $X_4$ is Y, I, S, A, N, F, or null; $X_5$ is D, A, or null; $X_6$ is E, K, Q, S, T, G, D, or null; $X_7$ is Q, S, N, R, G, L, or D; and $X_8$ is N, K, E, V, or L.

In some aspects, the TCR or antigen-binding fragment thereof contains a Vβ region that contains a complementarity determining region 3 (CDR-3) comprising the amino acid sequence $ASSX_4X_5X_6X_7X_8X_9X_{10}X_{11}X_{12}X_{13}$ (SEQ ID NO: 258), where $X_4$ is H, P, L, or Y; $X_5$ is L, G, W, F, or S; $X_6$ is A, G, or L; $X_7$ is G, E, A, T, or null; $X_8$ is F, G, T, or S; $X_9$ is T, N, H, or A; $X_{10}$ is G, T, Q, D, or Y; $X_{11}$ is E, P, T, or G; $X_{12}$ is L, A, Q, or Y; and $X_{13}$ is F, H, Y, or T.

In some aspects, the TCR or antigen-binding fragment thereof contains a Vβ region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}$ (SEQ ID NO: 1211), where $X_1$ is A, S, or V; $X_2$ is S, A, or V; $X_3$ is 5, V, R, or Q; $X_4$ is H, P, Q, L, Y, G, T, F, S, R, or E; $X_5$ is L, G, R, W, F, S, V, T, Y, Q, or null; $X_6$ is A, G, L, T, E, P, or null; $X_7$ is G, T, A, R, Q, N, S, or null; $X_8$ is G, S, or null; $X_9$ is G, or null; $X_{10}$ is F, G, A, S, T, R, Q, L, or null; $X_{11}$ is T, N, F, A, R, S, G, or null; $X_{12}$ is G, T, L D, Y, N, Q, S, or E; $X_{13}$ is E, W, T, G, K, N, or P; $X_{14}$ is L, A, K, Q, Y, or I; and $X_{15}$ is F, H, Y, T, or I.

In some aspects, the TCR or antigen-binding fragment thereof contains a Vβ region that contains a complementarity determining region 3 (CDR-3) comprising the amino acid sequence $X_1X_2X_3X_4X_5X_6X_7X_8X_9X_{10}X_{11}X_{12}X_{13}X_{14}X_{15}$ (SEQ ID NO: 1222), where $X_1$ is A, S, or V; $X_2$ is S, A, or V; $X_3$ is S, R, or Q; $X_4$ is H, P, Q, L, Y, G, T, F, S, R, or E; $X_5$ is L, G, R, W, F, S, V, T, Y, Q, or null; $X_6$ is A, G, L, E, P, or null; $X_7$ is G, T, A, R, Q, N, S, or null; $X_8$ is G, S, or null; $X_9$ is G, or null; $X_{10}$ is F, G, A, S, T, R, Q, L, or null; $X_{11}$ is T, N, F, A, R, S, G, or null; $X_{12}$ is G, T, L D, Y, N, Q, S, or E; $X_{13}$ is E, W, T, G, K, N, or P; $X_{14}$ is L, A, K, Q, Y, or I; and $X_{15}$ is F, H, Y, T, or I.

In some aspects, the TCR or antigen-binding fragment thereof contains a Vβ region that contains a complementarity determining region 3 (CDR-3) comprising the amino acid sequence $ASSX_4X_5X_6X_7X_8X_9X_{10}X_{11}X_{12}X_{13}X_{14}$ (SEQ ID NO: 1212), where $X_4$ is H, P, Q, L, Y, F, R, or E; $X_5$ is L, G, R, W, F, S, V, T, Y, or Q; $X_6$ is A, G, L, E P; $X_7$ is G, T, A, R, Q, S, or null; $X_8$ is G, S, or null; $X_9$ is F, G, A, S, T, R, L, or null; $X_{10}$ is T, N, A, F, R, S, or G; $X_{11}$ is G, T, L, D, Y, Q, S, E, or N; $X_{12}$ is E, W, T, G, P, K; $X_{13}$ is L, A, K, Q, Y, or I; and $X_{14}$ is F, H, Y, or T.

In some aspects, the TCR or antigen-binding fragment thereof contains a Vβ region that contains a complementarity determining region 3 (CDR-3) comprising the amino acid sequence $X_1X_2X_3X_4X_5X_6X_7X_8X_9X_{10}X_{11}X_{12}X_{13}QY$ (SEQ ID NO: 1213), where $X_1$ is A, or S; $X_2$ is 5, V, or A; $X_3$ is S, or V; $X_4$ is L, Y, P, or S; $X_5$ is W, F, V, L, or Y; $X_6$ is G, T, or A; $X_7$ is A, R, Q, S, or null; $X_8$ is G, or null; $X_9$ is G, or null; $X_{10}$ is S, T, R, or G; $X_{11}$ is T, A, R, S, or N; $X_{12}$ is D, Y, T, or G; and $X_{13}$ is T, or E.

In some aspects, the TCR or antigen-binding fragment thereof contains a Vβ region that contains a complementarity determining region 3 (CDR-3) comprising the amino acid sequence $X_1X_2X_3X_4X_5X_6X_7X_8X_9X_{10}X_{11}X_{12}X_{13}QY$ (SEQ ID NO: 1223), where $X_1$ is A, or S; $X_2$ is S, or A; $X_4$ is L, Y, P, or S; $X_5$ is W, F, V, L, or Y; $X_6$ is G, or A; $X_7$ is A, R, Q, S, or null; $X_8$ is G, or null; $X_9$ is G, or null; $X_{10}$ is S, T, R, or G; $X_{11}$ is T, A, R, S, or N; $X_{12}$ is D, Y, T, or G; and $X_{13}$ is T, or E.

In some aspects, the TCR or antigen-binding fragment thereof contains a Vβ region that contains a complementarity determining region 3 (CDR-3) comprising the amino acid sequence $ASX_3X_4X_5X_6X_7X_8X_9X_{10}X_{11}X_{12}F$ (SEQ ID NO: 1214), where $X_3$ is S, Q, or R; $X_4$ is H, P, T, or E; $X_5$ is L, G, W, or F; $X_6$ is A, G, or null; $X_7$ is G, N, S, R, or null; $X_8$ is F, G, Q, L, A, or null; $X_9$ is T, N, or A; $X_{10}$ is G, T, N, or E; $X_{11}$ is E, N, or K; and $X_{12}$ is L, A, or Q.

In some aspects, the TCR or antigen-binding fragment thereof contains a Vβ region that contains a complementarity determining region 3 (CDR-3) comprising the amino acid sequence $ASSX_4X_5X_6X_7X_8NYX_{11}YT$ (SEQ ID NO: 1215), where $X_4$ is L, or R; $X_5$ is S, or T; $X_6$ is G, T, or A; $X_7$ is T, or null; $X_8$ is G, or null; and $X_{11}$ is G, or null.

In some aspects, the TCR or antigen-binding fragment thereof contains a Vβ region that contains a complementarity determining region 3 (CDR-3) comprising the amino acid sequence $ASSX_4WGX_7SNQPX_{12}H$ (SEQ ID NO:1216), where $X_4$ is L, F, or P; $X_7$ is R, or Q; and $X_{12}$ is Q, or L.

In some aspects, the TCR or antigen-binding fragment thereof contains a Vβ region that contains a complementarity determining region 3 (CDR-3) comprising the amino acid sequence $ASSX_4X_5X_6X_7X_8SGNTIY$ (SEQ ID NO:1217), where $X_4$ is L, or R; $X_5$ is W, or Q; $X_6$ is G, or P; $X_7$ is R, or S; and $X_8$ is S, or null.

In some instances, the Vβ region contains a complementarity determining region 1 (CDR-1) comprising the amino acid sequence $X_1X_2HX_4X_5$ (SEQ ID NO: 252), where $X_1$ is S or M; $X_2$ is G, E, D, or N; $X_4$ is V, N, or E; and $X_5$ is S, R, N, or Y. In some instances, the Vβ region contains a complementarity determining region 1 (CDR-1) comprising the amino acid sequence $X_1X_2X_3X_4X_5X_6$ (SEQ ID NO: 1218), where $X_1$ is S, M, D, or L; $X_2$ is G, E, D, N, Q, S, or F; $X_3$ is H, V, Y, N, or Q; $X_4$ is A, S, F, or null; $X_5$ is W V, N, E, T, P, Y, K, D, or L; and $X_6$ is S, R, A, N, Y, M, or T.

In some cases, the Vβ region contains a complementarity determining region 2 (CDR-2) comprising the amino acid sequence $X_1X_2X_3X_4X_5X_6$ (SEQ ID NO: 255), where $X_1$ is F or S; $X_2$ is Q, Y, or V; $X_3$ is N, D, or G; $X_4$ is E or V; $X_5$ is A, K, or G; and $X_6$ is Q, M, or T. In some cases, the Vβ region contains a complementarity determining region 2 (CDR-2) comprising the amino acid sequence $X_1X_2X_3X_4X_5X_6X_7$ (SEQ ID NO: 1219), where $X_1$ is F, Y, S, A M; $X_2$ is N, Q, V, T, Y, or A; $X_3$ is N, D, E, S, G, I, F, Q, or L; $X_4$ is G, A, N, or null; $X_5$ is E, K, V, E, S, T, G, or N; $X_6$ is A, E, K, G, L, D, V, or N; and $X_7$ is Q, M, T, A, V, E, P, D, or I.

In some embodiments, the Vα region contains a complementarity determining region 3 (CDR-3) comprising an amino acid sequence set forth in any of SEQ ID NOs: 138, 144, 147, 163, 167 173, 304, 308, 478, 493, 505, 511, 523, 539, 555, 572, 588, 600, 612, 624, 638, 650, 662, or 679, or a sequence having at least at or about 90, 91, 92, 93, 94, 95, 96, 97, 98, or 99% identity with such a sequence. In some examples, the Vα region contains a CDR3 contained within the amino acid sequence set forth in any of SEQ ID NOs: 111, 113, 115, 121, 123 125, 297, 299, 477, 492, 504, 510, 522, 536, 554, 569, 587, 599, 611, 623, 637, 649, 661, or 676, or a sequence having at least at or about 90, 91, 92, 93, 94, 95, 96, 97, 98, or 99% identity with such a sequence. In some embodiments, the Vα region further contains a complementarity determining region 1 (CDR-1) comprising an amino acid sequence set forth in any of SEQ ID NOs: 136, 142, 161, 165 171, 302, 306, 537, 570, or 677, or a sequence having at least at or about 90, 91, 92, 93, 94, 95, 96, 97, 98, or 99% identity with such a sequence. In some aspects, the Vα region contains a CDR-1 contained within the amino acid sequence set forth in any of SEQ ID NOs: 111, 113, 115, 121, 123 125, 297, 299, 477, 492, 504, 510, 522, 536, 554, 569, 587, 599, 611, 623, 637, 649, 661, or 676, or a sequence having at least at or about 90, 91, 92, 93, 94, 95, 96, 97, 98, or 99% identity with such a sequence. In some embodiments, the Vα region further contains a complementarity determining region 2 (CDR-2) comprising an amino acid sequence set forth in any of SEQ ID NOs: 137, 143, 162, 166, 172, 303, 307, 538, 571, or 678, or a sequence having at least at or about 90, 91, 92, 93, 94, 95, 96, 97, 98, or 99% identity with such a sequence. In some cases, the Vα region contains a CDR-2 contained within the amino acid sequence set forth in any of SEQ ID NOs: 111, 113, 115, 121, 123 125, 297, 299, 477, 492, 504, 510, 522, 536, 554, 569, 587, 599, 611, 623, 637, 649, 661, or 676, or a sequence having at least at or about 90, 91, 92, 93, 94, 95, 96, 97, 98, or 99% identity with such a sequence.

In some embodiments, the Vβ region contains a complementarity determining region 3 (CDR-3) comprising an amino acid sequence set forth in any of SEQ ID NOs: 141, 146, 150, 164, 170 174, 305, 309, 486, 499, 517, 531, 548, 563, 581, 594, 606, 618, 630, 644, 656, 670, or 686, or a CDR3 contained within the amino acid sequence set forth in any of SEQ ID NOs: 112, 114, 116, 122, 124 126, 298, 300, 483, 498, 498, 516, 530, 545, 560, 578, 593, 605, 617, 629, 643, 655, 667, or 685, or a sequence having at least at or about 90, 91, 92, 93, 94, 95, 96, 97, 98, or 99% identity with such a sequence. In some embodiments, the Vβ region contains a complementarity determining region 1 (CDR-1) comprising an amino acid sequence set forth in any of SEQ ID NOs: 139, 145, 148, 168, 484, 546, 561, 579, or 668, or a sequence having at least at or about 90, 91, 92, 93, 94, 95, 96, 97, 98, or 99% identity with such a sequence. In some instances, the Vβ region contains a CDR-1 contained within the amino acid sequence set forth in any of SEQ ID NOs: 112, 114, 116, 122, 124 126, 298, 300, 483, 498, 498, 516, 530, 545, 560, 578, 593, 605, 617, 629, 643, 655, 667, or 685, or a sequence having at least at or about 90, 91, 92, 93, 94, 95, 96, 97, 98, or 99% identity with such a sequence. In some embodiments, the Vβ region further contains a complementarity determining region 2 (CDR-2) comprising an amino acid sequence set forth in any of SEQ ID NOs: 140, 149, 169, 485, 547, 562, 580, or 669, or a sequence having at least at or about 90, 91, 92, 93, 94, 95, 96, 97, 98, or 99% identity with such a sequence. In some examples, the Vβ region contains a CDR-2 contained within the amino acid sequence set forth in any of SEQ ID NOs: 112, 114, 116, 122, 124 126, 298, 300, 483, 498, 498, 516, 530, 545, 560, 578, 593, 605, 617, 629, 643, 655, 667, or 685, or a sequence having at least at or about 90, 91, 92, 93, 94, 95, 96, 97, 98, or 99% identity with such a sequence.

In some embodiments, the TCR or antigen-binding fragment thereof contains a Vα region that contains a complementarity determining region 1 (CDR-1) comprising an amino acid sequence set forth in any of SEQ ID NOs: 136, 142, 161, 165, 171, 302, 306, 537, 570, or 677, a complementarity determining region 2 (CDR-2) comprising an amino acid sequence set forth in any of SEQ ID NOs: 137, 143, 162, 166, 172, 303, 307, 538, 571, or 678, and/or a complementarity determining region 3 (CDR-3) comprising an amino acid sequence set forth in any of SEQ ID NOs: 138, 144, 147, 163, 167 173, 304, 308, 478, 493, 505, 511, 523, 539, 555, 572, 588, 600, 612, 624, 638, 650, 662, or 679. Also among the provided TCRs are those having sequences at least at or about 90, 91, 92, 93, 94, 95, 96, 97, 98, or 99% identical to such sequences. In some aspects, the TCR or antigen-binding fragment thereof contains a Vβ region that contains a complementarity determining region 1 (CDR-1) comprising an amino acid sequence set forth in any of SEQ ID NOs: 139, 145, 148, 168, 484, 546, 561, 579, or 668, a complementarity determining region 2 (CDR-2) comprising an amino acid sequence set forth in any of SEQ ID NOs: 140, 149, 169, 485, 547, 562, 580, or 669, and/or a complementarity determining region 3 (CDR-3) comprising an amino acid sequence set forth in any of SEQ ID NOs: 141, 146, 150, 164, 170 174, 305, 309, 486, 499, 517, 531, 548, 563, 581, 594, 606, 618, 630, 644, 656, 670, or 686. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 138, respectively. In some such embodiments, the Vβ region contains a CDR-1, CDR-2, and CDR-3, comprising the amino acid sequences of SEQ ID NOs: 139, 140, and 141, respectively. Also among the provided TCRs are those having sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 142, 143, and 144, respectively. In some such embodiments, the Vβ region contains a CDR-1, CDR-2, and CDR-3, comprising the amino acid sequences of SEQ ID NOs: 145, 140, and 146, respectively. Also among the provided TCRs are those having sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 136, 137, and 147, respectively. In some such embodiments, the Vβ region contains a CDR-1, CDR-2, and CDR-3, comprising the amino acid sequences of SEQ ID NOs: 148, 149, and 150, respectively. Also among the provided TCRs are those containing sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 161, 162, and 163, respectively. In some such embodiments, the Vβ region contains a CDR-1, CDR-2, and CDR-3, comprising the amino acid sequences of SEQ ID NOs: 148, 149, and 164, respectively. Also among the provided TCRs are those containing sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 165, 166, and 167, respectively. In some such embodiments, the Vβ region contains a CDR-1, CDR-2, and CDR-3, comprising the amino acid sequences of SEQ ID NOs: 168, 169, and 170, respectively. Also among the provided TCRs are those containing sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 171, 172, and 173, respectively. In some such embodiments, the Vβ region contains a CDR-1, CDR-2, and CDR-3, comprising the amino acid sequences of SEQ ID NOs: 148, 149, and 174, respectively. Also among the provided TCRs are those containing sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 302, 303, and 304, respectively. In some such embodiments, the Vβ region contains a CDR-1, CDR-2, and CDR-3, comprising the amino acid sequences of SEQ ID NOs: 139, 140, and 305, respectively. Also among the provided TCRs are those containing sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 306, 307, and 308, respectively. In some such embodiments, the Vβ region contains a CDR-1, CDR-2, and CDR-3, comprising the amino acid sequences of SEQ ID NOs: 148, 149, and 309, respectively. Also among the provided TCRs are those containing sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 478, respectively. In some such embodiments, the Vβ region contains a CDR-1, CDR-2, and CDR-3, comprising the amino acid sequences of SEQ ID NOs: 484, 485, and 486, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 161, 162, and 493, respectively. In some such embodiments, the Vβ region contains a CDR-1, CDR-2, and CDR-3, comprising the amino acid sequences of SEQ ID NOs: 148, 149, and 499, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 165, 166, and 505, respectively. In some such embodiments, the Vβ region contains a CDR-1, CDR-2, and CDR-3, comprising the amino acid sequences of SEQ ID NOs: 148, 149, and 499, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 161, 162, and 511, respectively. In some such embodiments, the Vβ region contains a CDR-1, CDR-2, and CDR-3, comprising the amino acid sequences of SEQ ID NOs: 148, 149, and 517, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 523, respectively. In some such embodiments, the Vβ region contains a CDR-1, CDR-2, and CDR-3, comprising the amino acid sequences of SEQ ID NOs: 148, 149, and 531, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 537, 538, and 539, respectively. In some such embodiments, the Vβ region contains a CDR-1, CDR-2, and CDR-3, comprising the amino acid sequences of SEQ ID NOs: 546, 547, and 548, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 555, respectively. In some such embodiments, the Vβ region contains a CDR-1, CDR-2, and CDR-3, comprising the amino acid sequences of SEQ ID NOs: 561, 562, and 563, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 570, 571, and 572, respectively. In some such embodiments, the Vβ region contains a CDR-1, CDR-2, and CDR-3, comprising the amino acid sequences of SEQ ID NOs: 579, 580, and 581, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 588, respectively. In some such embodiments, the Vβ region contains a CDR-1, CDR-2, and CDR-3, comprising the amino acid sequences of SEQ ID NOs: 148, 149, and 594, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 600, respectively. In some such embodiments, the Vβ region contains a CDR-1, CDR-2, and CDR-3, comprising the amino acid sequences of SEQ ID NOs: 148, 149, and 606, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 612, respectively. In some such embodiments, the Vβ region contains a CDR-1, CDR-2, and CDR-3, comprising the amino acid sequences of SEQ ID NOs: 148, 149, and 618, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 624, respectively. In some such embodiments, the Vβ region contains a CDR-1, CDR-2, and CDR-3, comprising the amino acid sequences of SEQ ID NOs: 168, 169, and 630, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 142, 143, and 638, respectively. In some such embodiments, the Vβ region contains a CDR-1, CDR-2, and CDR-3, comprising the amino acid sequences of SEQ ID NOs: 561, 562, and 644, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 171, 172, and 650, respectively. In some such embodiments, the Vβ region contains a CDR-1, CDR-2, and CDR-3, comprising the amino acid sequences of SEQ ID NOs: 148, 149, and 656, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 136, 137, and 662, respectively. In some such embodiments, the Vβ region contains a CDR-1, CDR-2, and CDR-3, comprising the amino acid sequences of SEQ ID NOs: 668, 669, and 670, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 677, 678, and 679, respectively. In some such embodiments, the Vβ region contains a CDR-1, CDR-2, and CDR-3, comprising the amino acid sequences of SEQ ID NOs: 154, 155, and 686, respectively. Also among the provided TCRs are those having sequences at least at or about 90, 91, 92, 93, 94, 95, 96, 97, 98, or 99% identical to such sequences.

In some embodiments, the Vα region contains a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 111, 113, 115, 121, 123 125, 297, 299, 477, 492, 504, 510, 522, 536, 554, 569, 587, 599, 611, 623, 637, 649, 661, or 676. In some aspects, the Vβ region contains a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 112, 114, 116, 122, 124 126, 298, 300, 483, 498, 498, 516, 530, 545, 560, 578, 593, 605, 617, 629, 643, 655, 667, or 685. Also among the provided TCRs are those containing sequences at least at or about 90, 91, 92, 93, 94, 95, 96, 97, 98, or 99% identical to such sequences.

In some embodiments, the TCR or antigen-binding fragment includes a Vα region that contains a complementarity determining region 1 (CDR-1), a CDR-2, and a CDR-3, respectively comprising the CDR-1, CDR-2, and CDR-3 amino acid sequences set forth in Table 2; and a Vβ region that contains a complementarity determining region 1 (CDR-1), a CDR-2, and a CDR-3, respectively comprising the CDR-1, CDR-2, and CDR-3 amino acid sequences set forth in Table 2. Also among the provided TCRs are those containing sequences at least at or about 90, 91, 92, 93, 94, 95, 96, 97, 98, or 99% identical to such sequences. Exemplary TCRs containing such CDRs, or their modified versions as described elsewhere herein, also are set forth in the Table 2.

TABLE 2

HPV16 E6(29-38) TCR CDR SEQ ID NOs.

| Exemplary | Alpha | | | Beta | | |
|---|---|---|---|---|---|---|
| TCR | CDR1 | CDR2 | CDR3 | CDR1 | CDR2 | CDR3 |
| TCR 3 | 136 | 137 | 138 | 139 | 140 | 141 |
| TCR 4 | 142 | 143 | 144 | 145 | 140 | 146 |
| TCR 5 | 136 | 137 | 147 | 148 | 149 | 150 |
| TCR 8 | 161 | 162 | 163 | 148 | 149 | 164 |
| TCR 9 | 165 | 166 | 167 | 168 | 169 | 170 |
| TCR 10 | 171 | 172 | 173 | 148 | 149 | 174 |
| TCR 13 | 302 | 303 | 304 | 139 | 140 | 305 |
| TCR 14 | 306 | 307 | 308 | 148 | 149 | 309 |
| TCR 15 | 136 | 137 | 478 | 484 | 485 | 486 |
| TCR 16 | 161 | 162 | 493 | 148 | 149 | 499 |
| TCR 17 | 165 | 166 | 505 | 148 | 149 | 499 |
| TCR 18 | 161 | 162 | 511 | 148 | 149 | 517 |
| TCR 19 | 136 | 137 | 523 | 148 | 149 | 531 |
| TCR 20 | 537 | 538 | 539 | 546 | 547 | 548 |
| TCR 21 | 136 | 137 | 555 | 561 | 562 | 563 |
| TCR 22 | 570 | 571 | 572 | 579 | 580 | 581 |
| TCR 23 | 136 | 137 | 588 | 148 | 149 | 594 |
| TCR 24 | 136 | 137 | 600 | 148 | 149 | 606 |
| TCR 25 | 136 | 137 | 612 | 148 | 149 | 618 |
| TCR 26 | 136 | 137 | 624 | 168 | 169 | 630 |
| TCR 27 | 142 | 143 | 638 | 561 | 562 | 644 |
| TCR 28 | 171 | 172 | 650 | 148 | 149 | 656 |
| TCR 29 | 136 | 137 | 662 | 668 | 669 | 670 |
| TCR 30 | 677 | 678 | 679 | 154 | 155 | 686 |

In some instances, the TCR or antigen-binding fragment thereof contains Vα and Vβ regions containing the amino acid sequences of SEQ ID NOs: 111 and 112, respectively. In some embodiments, the Vα and Vβ regions contain the amino acid sequences of SEQ ID NOs: 113 and 114, respectively. In some cases, the Vα and Vβ regions contain the amino acid sequences of SEQ ID NOs: 115 and 116, respectively. In some embodiments, the Vα and Vβ regions contain the amino acid sequences of SEQ ID NOs: 121 and 122, respectively. In some aspects, the Vα and Vβ regions contain the amino acid sequences of SEQ ID NOs: 123 and 124, respectively. In some examples, the Vα and Vβ regions contain the amino acid sequences of SEQ ID NOs: 125 and 126, respectively. In some examples, the Vα and Vβ regions contain the amino acid sequences of SEQ ID NOs: 297 and 298, respectively. In some examples, the Vα and Vβ regions contain the amino acid sequences of SEQ ID NOs: 299 and 300, respectively. In some embodiments, the Vα and Vβ regions contain the amino acid sequences of SEQ ID NOs: 477 and 483, respectively. In some examples, the Vα and Vβ regions contain the amino acid sequences of SEQ ID NOs:

492 and 498, respectively. In some cases, the Vα and Vβ regions contain the amino acid sequences of SEQ ID NOs: 504 and 498, respectively. In some instances, the TCR or antigen-binding fragment thereof contains Vα and Vβ regions containing the amino acid sequences of SEQ ID NOs: 510 and 516, respectively. In some embodiments, the Vα and Vβ regions contain the amino acid sequences of SEQ ID NOs: 522 and 530, respectively. In some examples, the Vα and Vβ regions contain the amino acid sequences of SEQ ID NOs: 536 and 545, respectively. In some cases, the Vα and Vβ regions contain the amino acid sequences of SEQ ID NOs: 554 and 560, respectively. In some instances, the TCR or antigen-binding fragment thereof contains Vα and Vβ regions containing the amino acid sequences of SEQ ID NOs: 569 and 578, respectively. In some embodiments, the Vα and Vβ regions contain the amino acid sequences of SEQ ID NOs: 587 and 593, respectively. In some examples, the Vα and Vβ regions contain the amino acid sequences of SEQ ID NOs: 599 and 605, respectively. In some embodiments, the Vα and Vβ regions contain the amino acid sequences of SEQ ID NOs: 611 and 617, respectively. In some cases, the Vα and Vβ regions contain the amino acid sequences of SEQ ID NOs: 623 and 629, respectively. In some instances, the Vα and Vβ regions contain the amino acid sequences of SEQ ID NOs: 637 and 643, respectively. In some cases, the Vα and Vβ regions contain the amino acid sequences of SEQ ID NOs: 649 and 655, respectively. In some examples, the Vα and Vβ regions contain the amino acid sequences of SEQ ID NOs: 661 and 667, respectively. In some cases, the Vα and Vβ regions contain the amino acid sequences of SEQ ID NOs: 676 and 685, respectively. Also among the provided TCRs are those containing sequences at least at or about 90, 91, 92, 93, 94, 95, 96, 97, 98, or 99% identical to such sequences.

In some embodiments, the alpha chain of the TCR or antigen-binding fragment thereof further contains a Cα region or portion thereof and/or the beta chain further contains a Cβ region or portion thereof. In some embodiments, the Cα region or portion thereof comprises the amino acid sequence set forth in any of SEQ ID NOs: 212, 213, 215, 218, or 524, or a sequence of amino acids that has at least 90% sequence identity thereto, such as a sequence having at least at or about 90, 91, 92, 93, 94, 95, 96, 97, 98, or 99% identity with such a sequence. In some aspects, the Cβ region contains the amino acid sequence set forth in SEQ ID NO: 214, 216, or 631, or a sequence of amino acids that has at least 90% sequence identity thereto, such as a sequence having at least at or about 90, 91, 92, 93, 94, 95, 96, 97, 98, or 99% identity with such a sequence. In some embodiments, the Cα and/or Cβ regions are modified, for example, by incorporation of one or more non-native cysteine residues, such as any described herein. In some embodiments, the Cα region or portion thereof contains a non-native cysteine at residue 48 and comprises the amino acid sequence set forth in any of SEQ ID NOs: 196, 198, 201, 203, or 525, or a sequence of amino acids that has at least 90% sequence identity thereto, such as a sequence having at least at or about 90, 91, 92, 93, 94, 95, 96, 97, 98, or 99% identity with such a sequence and that contains the introduced non-native cysteine residue (e.g. Cys48). In some aspects, the Cβ region contains a non-native cysteine at residue 57 and contains the amino acid sequence set forth in SEQ ID NO: 197, 199, or 632, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 18, 28, 38, 68, 78, 88, 287, 291, 473, 488, 500, 506, 518, 532, 550, 565, 583, 595, 607, 619, 633, 645, 657, or 672, or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 22, 32, 42, 72, 82, 92, 289, 293, 479, 494, 512, 526, 541, 556, 574, 589, 601, 613, 625, 639, 651, 663, or 681, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 19, 29, 39, 69, 79, 89, 288, 292, 474, 489, 501, 507, 519, 533, 551, 566, 584, 596, 608, 620, 634, 646, 658, or 673, or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 23, 33, 43, 73, 83, 93, 290, 294, 480, 495, 513, 527, 542, 557, 575, 590, 602, 614, 626, 640, 652, 664, or 682, or a sequence of amino acids that has at least 90% sequence identity thereto, such as a sequence having at least at or about 90, 91, 92, 93, 94, 95, 96, 97, 98, or 99% identity with such a sequence.

In some embodiments, the Vα and Vβ regions contain the amino acid sequences corresponding to the SEQ ID NOs. set forth in Table 3 or Table 4. In some aspects, the TCR contains constant alpha and constant beta region sequences, such as those corresponding to the SEQ ID NOs. set forth in Table 3 or Table 4. In some cases, the TCR contains a full sequence comprising the variable and constant chain, such as a sequence corresponding to the SEQ ID NOs. set forth in Tables 3 or 4("Full"). In some embodiments, the full sequence containing the variable and constant regions also includes a signal sequence and thus comprises a sequence corresponding to the SEQ ID NOs. set forth in Table 3 or 4 ("Full+signal"). Also among the provided TCRs are those containing sequences at least at or about 90, 91, 92, 93, 94, 95, 96, 97, 98, or 99% identical to such sequences. Exemplary TCRs containing such sequences, or their modified versions as described elsewhere herein, also are set forth in the Tables 3 and 4, respectively.

TABLE 3

| | Alpha | | | | Beta | | | |
|---|---|---|---|---|---|---|---|---|
| | HPV16 E6(29-38) TCR Native SEQ ID NOs. | | | | | | | |
| Exemplary TCR | Variable (Vα) | Constant | Full | Full + signal | Variable (Vβ) | Constant | Full | Full + signal |
| TCR 3 | 111 | 215 | 18 | 318 | 112 | 216 | 22 | 320 |
| TCR 4 | 113 | 213 | 28 | 322 | 114 | 214 | 32 | 324 |

TABLE 3-continued

HPV16 E6(29-38) TCR Native SEQ ID NOs.

| | Alpha | | | | Beta | | | |
|---|---|---|---|---|---|---|---|---|
| Exemplary TCR | Variable (Vα) | Constant | Full | Full + signal | Variable (Vβ) | Constant | Full | Full + signal |
| TCR 5 | 115 | 213 | 38 | 326 | 116 | 214 | 42 | 328 |
| TCR 8 | 121 | 213 | 68 | 338 | 122 | 216 | 72 | 110 |
| TCR 9 | 123 | 213 | 78 | 130 | 124 | 216 | 82 | 132 |
| TCR 10 | 125 | 212 | 88 | 134 | 126 | 214 | 92 | 179 |
| TCR 13 | 297 | 213 | 287 | 253 | 298 | 216 | 289 | 260 |
| TCR 14 | 299 | 218 | 291 | 313 | 300 | 214 | 293 | 315 |
| TCR 15 | 477 | 218 | 473 | 475 | 483 | 216 | 479 | 481 |
| TCR 16 | 492 | 213 | 488 | 490 | 498 | 214 | 494 | 496 |
| TCR 17 | 504 | 213 | 500 | 502 | 498 | 214 | 494 | 496 |
| TCR 18 | 510 | 213 | 506 | 508 | 516 | 214 | 512 | 514 |
| TCR 19 | 522 | 524 | 518 | 520 | 530 | 216 | 526 | 528 |
| TCR 20 | 536 | 218 | 532 | 534 | 545 | 216 | 541 | 543 |
| TCR 21 | 554 | 213 | 550 | 552 | 560 | 214 | 556 | 558 |
| TCR 22 | 569 | 524 | 565 | 567 | 578 | 214 | 574 | 576 |
| TCR 23 | 587 | 524 | 583 | 585 | 593 | 214 | 589 | 591 |
| TCR 24 | 599 | 524 | 595 | 597 | 605 | 216 | 601 | 603 |
| TCR 25 | 611 | 524 | 607 | 609 | 617 | 214 | 613 | 615 |
| TCR 26 | 623 | 213 | 619 | 621 | 629 | 631 | 625 | 627 |
| TCR 27 | 637 | 213 | 633 | 635 | 643 | 214 | 639 | 641 |
| TCR 28 | 649 | 213 | 645 | 647 | 655 | 214 | 651 | 653 |
| TCR 29 | 661 | 524 | 657 | 659 | 667 | 216 | 663 | 665 |
| TCR 30 | 676 | 213 | 672 | 674 | 685 | 214 | 681 | 683 |

TABLE 4

HPV16 E6(29-38) TCR Modified SEQ ID NOs.

| | Alpha | | | | Beta | | | |
|---|---|---|---|---|---|---|---|---|
| Exemplary modified version of TCR | Variable (Vα) | Constant | Full | Full + signal | Variable (Vβ) | Constant | Full | Full + signal |
| TCR 3 | 111 | 198 | 19 | 319 | 112 | 199 | 23 | 321 |
| TCR 4 | 113 | 196 | 29 | 323 | 114 | 197 | 33 | 325 |
| TCR 5 | 115 | 196 | 39 | 327 | 116 | 197 | 43 | 329 |
| TCR 8 | 121 | 203 | 69 | 339 | 122 | 199 | 73 | 129 |
| TCR 9 | 123 | 203 | 79 | 131 | 124 | 199 | 83 | 133 |
| TCR 10 | 125 | 198 | 89 | 135 | 126 | 197 | 93 | 180 |
| TCR 13 | 297 | 203 | 288 | 256 | 298 | 199 | 290 | 312 |
| TCR 14 | 299 | 201 | 292 | 314 | 300 | 197 | 294 | 316 |
| TCR 15 | 477 | 201 | 474 | 476 | 483 | 199 | 480 | 482 |
| TCR 16 | 492 | 203 | 489 | 491 | 498 | 197 | 495 | 497 |
| TCR 17 | 504 | 203 | 501 | 503 | 498 | 197 | 495 | 497 |
| TCR 18 | 510 | 203 | 507 | 509 | 516 | 197 | 513 | 515 |
| TCR 19 | 522 | 525 | 519 | 521 | 530 | 199 | 527 | 529 |
| TCR 20 | 536 | 201 | 533 | 535 | 545 | 199 | 542 | 544 |
| TCR 21 | 554 | 203 | 551 | 553 | 560 | 197 | 557 | 559 |
| TCR 22 | 569 | 525 | 566 | 568 | 578 | 197 | 575 | 577 |
| TCR 23 | 587 | 525 | 584 | 586 | 593 | 197 | 590 | 592 |
| TCR 24 | 599 | 525 | 596 | 598 | 605 | 199 | 602 | 604 |
| TCR 25 | 611 | 525 | 608 | 610 | 617 | 197 | 614 | 616 |
| TCR 26 | 623 | 203 | 620 | 622 | 629 | 632 | 626 | 628 |
| TCR 27 | 637 | 203 | 634 | 636 | 643 | 197 | 640 | 642 |
| TCR 28 | 649 | 203 | 646 | 648 | 655 | 197 | 652 | 654 |
| TCR 29 | 661 | 525 | 658 | 660 | 667 | 199 | 664 | 666 |
| TCR 30 | 676 | 203 | 673 | 675 | 685 | 197 | 682 | 684 | b. HPV 16 E7(11-19)

In some cases, the TCR recognizes or binds a peptide epitope derived from HPV 16 E7 that is or contains E7(11-19) YMLDLQPET (SEQ ID NO: 236). In some embodiments, the TCR recognizes or binds HPV 16 E7(11-19) in the context of an MHC, such as an MHC class I, e.g., HLA-A2.

In some embodiments, the TCR or antigen-binding fragment thereof contains a Vα region containing a complementarity determining region 3 (CDR-3) comprising the amino acid sequence $X_1X_2SX_4X_5X_6X_7X_8X_9X_{10}X_{11}$ (SEQ ID NO: 249), where $X_1$ is A or V; $X_2$ is E or V; $X_4$ is I or R; $X_5$ is R or D; $X_6$ is G or N; $X_7$ is F or Y; $X_8$ is N or Q; $X_9$ is V or N; $X_{10}$ is L or F; and $X_{11}$ is H or V.

In some embodiments, the TCR or antigen-binding fragment thereof contains a Vα region containing a complementarity determining region 3 (CDR-3) comprising the amino acid sequence $X_1X_2X_3X_4X_5X_6X_7X_8X_9X_{10}X_{11}X_{12}X_{13}X_{14}$ (SEQ ID NO:1183), where $X_1$ is V, or A; $X_2$ is V, A, G, Q, M, or E; $X_3$ is S, G, A, N, Y, R, T, or P; $X_4$ is E, A, S, G, R. F, N, D, V, P, L, I, or M; $X_5$ is R, N, H, T, D, G, S, A, P, L, Q, or F; $X_6$ is G, H, N, A, S, L, T, or null; $X_7$ is T, S, G, or null; $X_8$ is G, or null; $X_9$ is G, Y, N, S, or null; $X_{10}$ is T, G, S, D, F, Y, A, N, or null; $X_{11}$ is Y, F, Y, Q, N, or R; $X_{12}$ is N, K, Q, or D; $X_{13}$ is Y, L, T, F, M, or V; and $X_{14}$ is I, T, S, V, R, or Y.

In some embodiments, the TCR or antigen-binding fragment thereof contains a Vα region containing a complementarity determining region 3 (CDR-3) comprising the amino acid sequence $VVX_3X_4X_5X_6X_7X_8GX_{10}X_{11}X_{12}X_{13}$ (SEQ ID NO:1184), where $X_3$ is S, N, or T; $X_4$ is R, or F; $X_5$ is D, or A; $X_6$ is N, or L; $X_7$ is T, or null; $X_8$ is Y, or G; $X_{10}$ is Q, or F; $X_{11}$ is N, or K; $X_{12}$ is F, or T; and $X_{13}$ is V, or I.

In some embodiments, the TCR or antigen-binding fragment thereof contains a Vα region containing a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO:1185), where $X_2$ is A, G, V, Q, M, or E; $X_3$ is S, G, N, A, Y, R, or P; $X_4$ is E, S, A, G, F, N, D, V, P, L, I, M, or R; $X_5$ is R, N, H, T, D, G, S, P, L, Q, or F; $X_6$ is G, H, A, S, T, or null; $X_7$ is T, S, G, or null; $X_8$ is G, or null; $X_9$ is G, N, S, or null; $X_{10}$ is T, G, S, D, F, Y, A, or N; $X_{11}$ is Y, F, Q, R, or N; $X_{12}$ is K, Q, or D; $X_{13}$ is Y, L, T, M, F, or V; and $X_{14}$ is I, T, S, R, Y, or V.

In some embodiments, the TCR or antigen-binding fragment thereof contains a Vα region containing a complementarity determining region 3 (CDR-3) comprising the amino acid sequence $X_1X_2X_3X_4X_5X_6X_7X_8X_9X_{10}KX_{12}I$ (SEQ ID NO:1186), where $X_1$ is A, or V; $X_2$ is A, V, or E; $X_3$ is S, N, T, R, or P; $X_4$ is E, A, G, F, V, P, I, D, or S; $X_5$ is R, H, T, A P, S, G, or F; $X_6$ is G, H, L, T, S, A, or null; $X_7$ is S, T, or null; $X_8$ is G, or null; $X_9$ is G, T, or null; $X_{10}$ is F, Y, or N; and $X_{12}$ is Y, T, or L.

In some embodiments, the TCR or antigen-binding fragment thereof contains a Vα region containing a complementarity determining region 3 (CDR-3) comprising the amino acid sequence $AX_2X_3X_4X_5X_6X_7X_8X_9YKYI$ (SEQ ID NO:1187), where $X_2$ is A, V, or E; $X_3$ is S, N, or R; $X_4$ is E, G, V, P, I, or D; $X_5$ is R, T, P, S, G, or F; $X_6$ is G, T, S, or null; $X_7$ is S, or null; $X_8$ is G, or null; and $X_9$ is T, or null.

In some embodiments, the TCR or antigen-binding fragment thereof contains a Vα region containing a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO:1188), where $X_2$ is G, V, Q, or M; $X_3$ is G, A, Y, S, N, or R; $X_4$ is S, G, L, I, M, or R; $X_5$ is N, D, G, S, L, Q, or R; $X_6$ is A, S, G, or null; $X_7$ is G, or null; $X_8$ is G, or null; $X_9$ is G, N, S, or null; $X_{10}$ is S, D, Y, A, N, or null; $X_{11}$ is Y, Q, or R; $X_{12}$ is K, or Q; $X_{13}$ is L, or V; and $X_{14}$ is S, T, or V.

In some embodiments, the TCR or antigen-binding fragment thereof contains a Vα region containing a complementarity determining region 3 (CDR-3) comprising the amino acid sequence $AX_2X_3X_4X_5X_6X_7X_8X_9X_{10}X_{11}X_{12}X_{13}T$ (SEQ ID NO:1189), where $X_2$ is G, V, or Q; $X_3$ is G, Y, S, or N; $X_4$ is S, L, or M; $X_5$ is N, G, L, or R; $X_6$ is A, S, G, or null; $X_7$ is G, or null; $X_8$ is G, or null; $X_9$ is G, S, or null; $X_{10}$ is S, Y, A, N, or null; $X_{11}$ is Y, Q, or R; $X_{12}$ is K, or Q; and $X_{13}$ is L, or V.

In some embodiments, the TCR or antigen-binding fragment thereof contains a Vα region containing a complementarity determining region 3 (CDR-3) comprising the amino acid sequence $AX_2X_3X_4X_5X_6X_7YKLS$ (SEQ ID NO:1190), where $X_2$ is G, or V; $X_3$ is A, or Y; $X_4$ is G, S, or R; $X_5$ is D, or S; $X_6$ is N, or null; and $X_7$ is D, or null.

In some embodiments, the Vα region contains a complementarity determining region 1 (CDR-1) comprising the amino acid sequence $X_1SX_3X_4X_5X_6$ (SEQ ID NO: 241), where $X_1$ is D or V; $X_3$ is S, or P; $X_4$ is S or F; $X_5$ is T or S; and $X_{6\ is}$ Y or N. In some embodiments, the Vα region contains a complementarity determining region 1 (CDR-1) comprising the amino acid sequence $X_1X_2X_3X_4X_5X_6$ (SEQ ID NO:1191), where $X_1$ is N, S, D, T, or V; $X_2$ is S, V, R, T, or I; $X_3$ is M, F, G, S, N, A, L, V, or P; $X_4$ is F, S, N, A, or null; $X_5$ is D, S, Q, Y, N, V, T, or P; and $X_6$ is Y, S, R, N, G, or T.

In some cases, the Vα region contains a complementarity determining region 2 (CDR-2) comprising the amino acid sequence $X_1X_2X_3X_4X_5X_6X_7$ (SEQ ID NO: 245), where $X_1$ is I or M; $X_2$ is F or T; $X_3$ is S or F; $X_4$ is N or S; $X_5$ is M or E; $X_6$ is D or N; and $X_7$ is M or T. In some embodiments, the Vα region contains a complementarity determining region 2 (CDR-2) comprising the amino acid sequence $X_1X_2X_3X_4X_5X_6X_7X_8$ (SEQ ID NO:1192), where $X_1$ is I, V, L, G, N, T, Y, or M; $X_2$ is S, V, Y, L, P, F, I, or T; $X_3$ is S, Y, K, L, T, or F; $X_4$ is I, G, N, A, S, or null; $X_5$ is S, D, or null; $X_6$ is K, G, N, S, D, T, or E; $X_7$ is D, E, G, A, K, L, or N; and $X_8$ is K, V, D, P, N, T, L, or M.

In some aspects, the TCR or antigen-binding fragment thereof contains a Vβ region containing a complementarity determining region 3 (CDR-3) comprising the amino acid sequence $AX_2TX_4RX_6X_7YX_9X_{10}X_{11}$ (SEQ ID NO: 259), where $X_2$ is S or I; $X_4$ is T or D; $X_6$ is S or T; $X_7$ is S or N; $X_9$ is E or G; $X_{10}$ is Q or Y; and $X_{11}$ is Y or T.

In some embodiments, the TCR or antigen-binding fragment thereof contains a Vβ region containing a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO: 1193), where $X_2$ is 5, M, I, K, or V; $X_3$ is S, T, N, or A; $X_4$ is R, V P, 5, T, G, L, A, I, or D; $X_5$ is F, G, R, Y, 5, L, V, or T; $X_6$ is L, G, D, A, S, T, V, R, or null; $X_7$ is G, D, R, S, T, or null; $X_8$ is S, or null; $X_9$ is S, H, G, R, V, T, D, L, or null; $X_{10}$ is T, S, A, Y, N, G, or P; $X_{11}$ is D, Y, N, E, K, or G; $X_{12}$ is T, E, G, or K; $X_{13}$ is Q, Y, A, or L; and $X_{14}$ is Y, F, T, or I.

In some embodiments, the TCR or antigen-binding fragment thereof contains a Vβ region containing a complementarity determining region 3 (CDR-3) comprising the amino acid sequence $AX_2TX_4X_5X_6X_7X_8X_9X_{10}X_{11}X_{12}$ (SEQ ID NO: 1194), where $X_2$ is 5, M, I, or K; $X_4$ is P, T, G, A, S, or D; $X_5$ is R, or S; $X_6$ is D, G, S, T, or V; $X_7$ is R, S, or null; $X_8$ is T, Y, G, N, or S; $X_9$ is Y, N, or K; $X_{10}$ is E, or G; $X_{11}$ is Q, A, or Y; and $X_{12}$ is Y, F, or T.

In some embodiments, the TCR or antigen-binding fragment thereof contains a Vβ region containing a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO: 1195), where $X_2$ is 5, M, I, or K; $X_3$ is S, T, A, or N; $X_4$ is R, V, S, P, T, G, L, or A; $X_5$ is F, G, R, Y, S, V, or T; $X_6$ is L, G, D, A, S, T, V, or null; $X_7$ is G, D, R, T, or null; $X_8$ is S, or null; $X_9$ is S, H, G, R, V, T, L, or null; $X_{10}$ is T, S, Y, A, N, G, or P; $X_{11}$ is D, Y, N, K, E, or G; $X_{12}$ is T, or E; $X_{13}$ is Q, A, or L; and $X_{14}$ is Y, or F.

In some embodiments, the TCR or antigen-binding fragment thereof contains a Vβ region containing a complementarity determining region 3 (CDR-3) comprising the amino acid sequence $AX_2X_3X_4X_5X_6X_7X_8X_9X_{10}X_{11}QY$ (SEQ ID NO: 1196), where $X_2$ is 5, M, I, or K; $X_3$ is S, T, A, or N;

$X_4$ is R, P, S, G, L, A, or T; $X_5$ is F, R, Y, V, or T; $X_6$ is L, D, A, S, T, V, or null; $X_7$ is G, R, or null; $X_8$ is S, G, V, or null; $X_9$ is T, A, G, N, S, or P; $X_{10}$ is D, Y, or E; and $X_{11}$ is T, or E.

In some embodiments, the TCR or antigen-binding fragment thereof contains a Vβ region containing a complementarity determining region 3 (CDR-3) comprising the amino acid sequence $AX_2X_3X_4X_5X_6X_7X_8X_9$1 YEQY (SEQ ID NO: 1197), where $X_2$ is 5, M, I, or K; $X_3$ is 5, T, A, or N; $X_4$ is P, S, G, T, or A; $X_5$ is R, or Y; $X_6$ is D, A, S, T, or V; $X_7$ is R, or null; $X_8$ is G, V, or null; and $X_9$ is S, T, A, or N.

In some embodiments, the TCR or antigen-binding fragment thereof contains a Vβ region containing a complementarity determining region 3 (CDR-3) comprising the amino acid sequence $ASTX_4X_5X_6X_7X_8X_9X_{10}X_{11}EX_{13}X_{14}$(SEQ ID NO: 1198), where $X_4$ is T, P, or G; $X_5$ is R, or S; $X_6$ is S, D, G, or V; $X_7$ is D, or null; $X_8$ is S, or null; $X_9$ is S, R, or null; $X_{10}$ is S, T, Y, or G; $X_{11}$ is Y, N, or K; $X_{13}$ is Q, or A; and $X_{14}$ is Y, or F.

In some embodiments, the TCR or antigen-binding fragment thereof contains a Vβ region containing a complementarity determining region 3 (CDR-3) comprising the amino acid sequence $AX_2X_3X_4X_5X_6X_7X_8$YGYT (SEQ ID NO: 1199), where $X_2$ is S, or I; $X_3$ is S, or T; $X_4$ is L, A, or D; $X_5$ is L, T, or R; $X_6$ is L, T, or R; $X_7$ is G, D, or null; and $X_8$ is A, or N.

In some embodiments, the TCR or antigen-binding fragment thereof contains a Vβ region containing a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO: 1200), where $X_2$ is 5, V, or I; $X_3$ is S, N, or A; $X_4$ is R, V, S, L, P, G, I, or A; $X_5$ is F, G, Y, L, V, R, T, or S; $X_6$ is L, G, A, D, R, V, or null; $X_7$ is G, D, R, S, T, or null; $X_8$ is S, or null; $X_9$ is S, H, G, V, T, D, L, or null; $X_{10}$ is T, S, A, G, P, N, or Y; $X_{11}$ is D, Y, E, G, or N; $X_{12}$ is T, E, G, or K; $X_{13}$ is Q, Y, or L; and $X_{14}$ is Y, F, T, or I.

In some embodiments, the TCR or antigen-binding fragment thereof contains a Vβ region containing a complementarity determining region 3 (CDR-3) comprising the amino acid sequence $ASSX_4X_5X_6X_7X_8X_9X_{10}X_{11}X_{12}X_{13}X_{14}$(SEQ ID NO: 1201), where $X_4$ is R, V, S, L, G, or A; $X_5$ is F, G, Y, L, V, T, or S; $X_6$ is A, L, R, D, G, or null; $X_7$ is G, D, T, or null; $X_8$ is S, or null; $X_9$ is S, H, G, T, D, L, or null; $X_{10}$ is T, S, A, G, P, N, or Y; $X_{11}$ is D, Y, E, G, or N; $X_{12}$ is T, E, G, or T; $X_{13}$ is Q, Y, or L; and $X_{14}$ is Y, F, or T.

In some embodiments, the TCR or antigen-binding fragment thereof contains a Vβ region containing a complementarity determining region 3 (CDR-3) comprising the amino acid sequence $ASSX_4X_5X_6X_7X_8X_9X_{10}$TQY (SEQ ID NO: 1202), where $X_4$ is R, L, or G; $X_5$ is F, V, T, or Y; $X_6$ is L, A, or null; $X_7$ is G, or null; $X_8$ is S, G, or null; $X_9$ is T, G, P, or S; and $X_{10}$ is D, or E.

In some embodiments, the Vβ region contains a complementarity determining region 1 (CDR-1) comprising the amino acid sequence $SX_2X_3X_4X_5$ (SEQ ID NO:1203), where $X_2$ is G, or N; $X_3$ is H, or D; $X_4$ is T, L, N, or V; and $X_5$ is A, S, Y, or T.

In some embodiments, the Vβ region contains a complementarity determining region 2 (CDR-2) comprising the amino acid sequence $X_1X_2X_3X_4X_5X_6$ (SEQ ID NO:1204), where $X_1$ is F, or Y; $X_2$ is Q, Y, or N; $X_3$ is G, N, R, or Y; $X_4$ is N, G, E, or T; $X_5$ is S, E, A, or G; and $X_6$ is A, E, I, or Q.

In some aspects, the Vβ region contains a complementarity determining region 1 (CDR-1) comprising the amino acid sequence set forth in SEQ ID NO: 154, 701, 719, or 751. In some embodiments, the Vβ region contains a complementarity determining region 2 (CDR-2) comprising the amino acid sequence set forth in SEQ ID NO: 155, 702, 720, 752, 918, or 1009.

In some embodiments, the Vα region contains a complementarity determining region 3 (CDR-3) comprising the amino acid sequence set forth in any of SEQ ID NOs: 153, 159, 301, 694, 712, 729, 744, 762, 776, 788, 802, 818, 832, 846, 858, 870, 882, 896, 911, 926, 940, 952, 964, 976, 988, or 1002, or a CDR3 contained within the amino acid sequence set forth in any of SEQ ID NOs: 117, 119, 295, 691, 709, 726, 741, 759, 775, 787, 799, 815, 830, 845, 857, 869, 881, 895, 908, 925, 937, 951, 963, 975, 987, or 999. In some embodiments, the Vα region contains a CDR3 sequence at least at or about 90, 91, 92, 93, 94, 95, 96, 97, 98, or 99% identical to such sequences.

In some embodiments, the Vα region further contains a complementarity determining region 1 (CDR-1) comprising an amino acid sequence set forth in any of SEQ ID NOs: 151, 157, 692, 710, 727, 742, 760, 800, 816, 909, 938, or 1000, or a sequence having at least at or about 90, 91, 92, 93, 94, 95, 96, 97, 98, or 99% identity with such a sequence. In some aspects, the Vα region further contains a complementarity determining region 2 (CDR-2) comprising an amino acid sequence set forth in any of SEQ ID NOs: 152, 158, 693, 711, 728, 743, 761, 801, 817, 831, 833, 910, 939, or 1001, or a sequence having at least at or about 90, 91, 92, 93, 94, 95, 96, 97, 98, or 99% identity with such a sequence.

In some aspects, the Vβ region contains a complementarity determining region 3 (CDR-3) comprising an amino acid sequence set forth in any of SEQ ID NOs: 156, 160, 703, 721, 736, 753, 769, 782, 794, 809, 825, 840, 852, 864, 876, 888, 902, 919, 932, 946, 958, 970, 982, 994, or 1010, or a CDR3 contained within the amino acid sequence set forth in any of SEQ ID NOs: 118, 120, 296, 700, 718, 735, 750, 768, 781, 793, 808, 824, 839, 851, 863, 875, 887, 901, 917, 931, 945, 957, 969, 981, 993, or 1008. In some embodiments, the Vβ region contains a CDR3 sequence at least at or about 90, 91, 92, 93, 94, 95, 96, 97, 98, or 99% identical to such sequences. In some embodiments, the Vβ region contains a complementarity determining region 1 (CDR-1) comprising the amino acid sequence set forth in SEQ ID NO: 154, 701, 719, or 751, or a sequence having at least at or about 90, 91, 92, 93, 94, 95, 96, 97, 98, or 99% identity with such a sequence. In some instances, the Vβ region contains a complementarity determining region 2 (CDR-2) comprising the amino acid sequence set forth in SEQ ID NO: 155, 702, 720, 752, 918, or 1009, or a sequence having at least at or about 90, 91, 92, 93, 94, 95, 96, 97, 98, or 99% identity with such a sequence.

In some embodiments, the TCR or antigen-binding fragment thereof contains a Vα region that contains a CDR-1, CDR-2, and CDR-3, comprising the amino acid sequences of SEQ ID NOs: 151, 152, and 153, respectively. In some such embodiments, the Vβ region contains a CDR-1, CDR-2, and CDR-3, comprising the amino acid sequences of SEQ ID NOs: 154, 155, and 156, respectively. Also among the provided TCRs are those having sequences at least at or about 90, 91, 92, 93, 94, 95, 96, 97, 98, or 99% identical to such sequences.

In some aspects, the Vα region contains a CDR-1, CDR-2, and CDR-3, comprising the amino acid sequences of SEQ ID NOs: 157, 158, and 159, respectively. In some such aspects, the Vβ region contains a CDR-1, CDR-2, and CDR-3, comprising the amino acid sequences of SEQ ID NOs: 154, 155, and 160, respectively. Also among the provided TCRs are those having sequences at least at or about 90, 91, 92, 93, 94, 95, 96, 97, 98, or 99% identical to such sequences.

In some embodiments, the Vα region contains a CDR-1, CDR-2, and CDR-3, comprising the amino acid sequences of SEQ ID NOs: 151, 152, and 301, respectively. In some such embodiments, the Vβ region contains a CDR-1, CDR-2, and CDR-3, comprising the amino acid sequences of SEQ ID NOs: 154, 155, and 156, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 692, 693, and 694, respectively. In some such embodiments, the Vβ region contains a CDR-1, CDR-2, and CDR-3, comprising the amino acid sequences of SEQ ID NOs: 701, 702, and 703, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 710, 711, and 712, respectively. In some such embodiments, the Vβ region contains a CDR-1, CDR-2, and CDR-3, comprising the amino acid sequences of SEQ ID NOs: 719, 720, and 721, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 727, 728, and 729, respectively. In some such embodiments, the Vβ region contains a CDR-1, CDR-2, and CDR-3, comprising the amino acid sequences of SEQ ID NOs: 154, 155, and 736, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 742, 743, and 744, respectively. In some such embodiments, the Vβ region contains a CDR-1, CDR-2, and CDR-3, comprising the amino acid sequences of SEQ ID NOs: 751, 752, and 753, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 760, 761, and 762, respectively. In some such embodiments, the Vβ region contains a CDR-1, CDR-2, and CDR-3, comprising the amino acid sequences of SEQ ID NOs: 719, 720, and 769, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 171, 172, and 776, respectively. In some such embodiments, the Vβ region contains a CDR-1, CDR-2, and CDR-3, comprising the amino acid sequences of SEQ ID NOs: 154, 155, and 782, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 742, 743, and 788, respectively. In some such embodiments, the Vβ region contains a CDR-1, CDR-2, and CDR-3, comprising the amino acid sequences of SEQ ID NOs: 139, 140, and 794, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 800, 801, and 802 respectively. In some such embodiments, the Vβ region contains a CDR-1, CDR-2, and CDR-3, comprising the amino acid sequences of SEQ ID NOs: 751, 752, and 809, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 816, 817, and 818, respectively. In some such embodiments, the Vβ region contains a CDR-1, CDR-2, and CDR-3, comprising the amino acid sequences of SEQ ID NOs: 154, 155, and 825, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 816, 831, and 832, respectively. In some such embodiments, the Vβ region contains a CDR-1, CDR-2, and CDR-3, comprising the amino acid sequences of SEQ ID NOs: 154, 155, and 840, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 171, 172, and 846, respectively. In some such embodiments, the Vβ region contains a CDR-1, CDR-2, and CDR-3, comprising the amino acid sequences of SEQ ID NOs: 154, 155, and 852, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 816, 833, and 858, respectively. In some such embodiments, the Vβ region contains a CDR-1, CDR-2, and CDR-3, comprising the amino acid sequences of SEQ ID NOs: 154, 155, and 864, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 727, 728, and 870, respectively. In some such embodiments, the Vβ region contains a CDR-1, CDR-2, and CDR-3, comprising the amino acid sequences of SEQ ID NOs: 154, 155, and 876, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 570, 571, and 882, respectively. In some such embodiments, the Vβ region contains a CDR-1, CDR-2, and CDR-3, comprising the amino acid sequences of SEQ ID NOs: 719, 720, and 888, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 816, 817, and 896, respectively. In some such embodiments, the Vβ region contains a CDR-1, CDR-2, and CDR-3, comprising the amino acid sequences of SEQ ID NOs: 701, 702, and 902, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 909, 910, and 911, respectively. In some such embodiments, the Vβ region contains a CDR-1, CDR-2, and CDR-3, comprising the amino acid sequences of SEQ ID NOs: 701, 918, and 919, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 727, 728, and 926, respectively. In some such embodiments, the Vβ region contains a CDR-1, CDR-2, and CDR-3, comprising the amino acid sequences of SEQ ID NOs: 154, 155, and 932, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 938, 939, and 940, respectively. In some such embodiments, the Vβ region contains a CDR-1, CDR-2, and CDR-3, comprising the amino acid sequences of SEQ ID NOs: 154, 155, and 946, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 727, 728, and 952, respectively. In some such embodiments, the Vβ region contains a CDR-1, CDR-2, and CDR-3, comprising the amino acid sequences of SEQ ID NOs: 154, 155, and 958, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 151, 152, and 964, respectively. In some such embodiments, the Vβ region contains a CDR-1, CDR-2, and CDR-3, comprising the amino acid sequences of SEQ ID NOs: 719, 720, and 970, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 727, 728, and 976, respectively. In some such embodiments, the Vβ region contains a CDR-1, CDR-2, and CDR-3, comprising the amino acid sequences of SEQ ID NOs: 154, 155, and 982, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 710, 711, and 988, respectively. In some such embodiments, the Vβ region contains a CDR-1, CDR-2, and CDR-3, comprising the amino acid sequences of SEQ ID NOs: 719, 720, and 994, respectively. Also among the provided TCRs are those having sequences at least at or about 90, 91, 92, 93, 94, 95, 96, 97, 98, or 99% identical to such sequences.

In some embodiments, the TCR or antigen-binding fragment thereof contains a Vα region that contains a CDR-1, CDR-2, and CDR-3, comprising the amino acid sequences of SEQ ID NOs: 1000, 1001, and 1002, respectively. In some such embodiments, the Vβ region contains a CDR-1, CDR-2, and CDR-3, comprising the amino acid sequences of SEQ ID NOs: 139, 1009, and 1010, respectively. Also among the provided TCRs are those having sequences at least at or about 90, 91, 92, 93, 94, 95, 96, 97, 98, or 99% identical to such sequences.

In some instances, the Vα region contains a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 117, 119, 295, 691, 709, 726, 741, 759, 775, 787, 799, 815, 830, 845, 857, 869, 881, 895, 908, 925, 937, 951, 963, 975, 987, or 999. In some cases, the Vβ region contains a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 118, 120, 296, 700, 718, 735, 750, 768, 781, 793, 808, 824, 839, 851, 863, 875, 887, 901, 917, 931, 945, 957, 969, 981, 993, or 1008. Also among the provided TCRs are those containing sequences at least at or about 90, 91, 92, 93, 94, 95, 96, 97, 98, or 99% identical to such sequences.

In some embodiments, the TCR or antigen-binding fragment includes a Vα region that contains a complementarity determining region 1 (CDR-1), a CDR-2, and a CDR-3, respectively comprising the CDR-1, CDR-2, and CDR-3 amino acid sequences set forth in Table S and a Vβ region that contains a complementarity determining region 1 (CDR-1), a CDR-2, and a CDR-3, respectively comprising the CDR-1, CDR-2, and CDR-3 amino acid sequences set forth in Table 5. Also among the provided TCRs are those containing sequences at least at or about 90, 91, 92, 93, 94, 95, 96, 97, 98, or 99% identical to such sequences. Exemplary TCRs containing such CDRs, or their modified versions as described elsewhere herein, also are set forth in the Table 5.

TABLE 5

HPV16 E7(11-19) TCR CDR SEQ ID NOs.

| Exemplary | Alpha | | | Beta | | |
|---|---|---|---|---|---|---|
| TCR | CDR1 | CDR2 | CDR3 | CDR1 | CDR2 | CDR3 |
| TCR 6 | 151 | 152 | 153 | 154 | 155 | 156 |
| TCR 7 | 157 | 158 | 159 | 154 | 155 | 160 |
| TCR 12 | 151 | 152 | 301 | 154 | 155 | 156 |
| TCR 31 | 692 | 693 | 694 | 701 | 702 | 703 |
| TCR 32 | 710 | 711 | 712 | 719 | 720 | 721 |
| TCR 33 | 727 | 728 | 729 | 154 | 155 | 736 |
| TCR 34 | 742 | 743 | 744 | 751 | 752 | 753 |
| TCR 35 | 760 | 761 | 762 | 719 | 720 | 769 |
| TCR 36 | 171 | 172 | 776 | 154 | 155 | 782 |
| TCR 37 | 742 | 743 | 788 | 139 | 140 | 794 |
| TCR 38 | 800 | 801 | 802 | 751 | 752 | 809 |
| TCR 39 | 816 | 817 | 818 | 154 | 155 | 825 |
| TCR 40 | 816 | 831 | 832 | 154 | 155 | 840 |
| TCR 41 | 171 | 172 | 846 | 154 | 155 | 852 |
| TCR 42 | 816 | 833 | 858 | 154 | 155 | 864 |
| TCR 43 | 727 | 728 | 870 | 154 | 155 | 876 |
| TCR 44 | 570 | 571 | 882 | 719 | 720 | 888 |
| TCR 45 | 816 | 817 | 896 | 701 | 702 | 902 |
| TCR 46 | 909 | 910 | 911 | 701 | 918 | 919 |
| TCR 47 | 727 | 728 | 926 | 154 | 155 | 932 |
| TCR 48 | 938 | 939 | 940 | 154 | 155 | 946 |
| TCR 49 | 727 | 728 | 952 | 154 | 155 | 958 |
| TCR 50 | 151 | 152 | 964 | 719 | 720 | 970 |
| TCR 51 | 727 | 728 | 976 | 154 | 155 | 982 |
| TCR 52 | 710 | 711 | 988 | 719 | 720 | 994 |
| TCR 53 | 1000 | 1001 | 1002 | 139 | 1009 | 1010 |
| TCR 54 | 157 | 158 | 159 | 154 | 155 | 160 |
| TCR 55 | 151 | 152 | 301 | 154 | 155 | 156 |

In some embodiments, the TCR or antigen-binding fragment thereof contains Vα and Vβ regions containing the amino acid sequences of SEQ ID NOs: 117 and either 118 or 296, respectively. In some aspects, the Vα and Vβ regions contain the amino acid sequences of SEQ ID NOs: 119 and 120, respectively. In some aspects, the Vα and Vβ regions contain the amino acid sequences of SEQ ID NOs: 295 and either 118 or 296, respectively. Also among the provided TCRs are those containing sequences at least at or about 90, 91, 92, 93, 94, 95, 96, 97, 98, or 99% identical to such sequences. In some cases, the Vα and Vβ regions contain the amino acid sequences of SEQ ID NOs: 691 and 700, respectively. In some instances, the Vα and Vβ regions contain the amino acid sequences of SEQ ID NOs: 709 and 718, respectively. In some aspects, the Vα and Vβ regions contain the amino acid sequences of SEQ ID NOs: 726 and 735, respectively. In some embodiments, the Vα and Vβ regions contain the amino acid sequences of SEQ ID NOs: 741 and 750, respectively. In some cases, the Vα and Vβ regions contain the amino acid sequences of SEQ ID NOs: 759 and 768, respectively. In some aspects, the Vα and Vβ regions contain the amino acid sequences of SEQ ID NOs: 775 and 781, respectively. In some embodiments, the Vα and Vβ regions contain the amino acid sequences of SEQ ID NOs: 787 and 793, respectively. In some examples, the Vα and Vβ regions contain the amino acid sequences of SEQ ID NOs: 799 and 808, respectively. In some cases, the Vα and Vβ regions contain the amino acid sequences of SEQ ID NOs: 815 and 824, respectively. In some instances, the Vα and Vβ regions contain the amino acid sequences of SEQ ID NOs: 830 and 839, respectively. In some embodiments, the Vα and Vβ regions contain the amino acid sequences of SEQ ID NOs: 845 and 851, respectively. In some aspects, the Vα and Vβ regions contain the amino acid sequences of SEQ ID NOs: 857 and 863, respectively. In some cases, the Vα and Vβ regions contain the amino acid sequences of SEQ ID NOs: 869 and 875, respectively. In some instances, the Vα and Vβ regions contain the amino acid sequences of SEQ ID NOs: 881 and 887, respectively. In some embodiments, the Vα and Vβ regions contain the amino acid sequences of SEQ ID NOs: 895 and 901, respectively. In some aspects, the Vα and Vβ regions contain the amino acid sequences of SEQ ID NOs: 908 and 917, respectively. In some cases, the Vα and Vβ regions contain the amino acid sequences of SEQ ID NOs: 925 and 931, respectively. In some instances, the Vα and Vβ regions contain the amino acid sequences of SEQ ID NOs: 937 and 945, respectively. In some examples, the Vα and Vβ regions contain the amino acid sequences of SEQ ID NOs: 951 and 957, respectively. In some cases, the Vα and Vβ regions contain the amino acid sequences of SEQ ID NOs: 963 and 969, respectively. In some instances, the Vα and Vβ regions contain the amino acid sequences of SEQ ID NOs: 975 and 981, respectively. In some cases, the Vα and Vβ regions contain the amino acid sequences of SEQ ID NOs: 987 and 993, respectively. In some embodiments, the Vα and Vβ regions contain the amino acid sequences of SEQ ID NOs: 999 and 1008, respectively.

In some embodiments, the alpha chain of the TCR or antigen-binding fragment thereof further contains a Cα region or portion thereof and/or the beta chain further contains a Cβ region or portion thereof. In some embodiments, the Cα region or portion thereof comprises the amino acid sequence set forth in any of SEQ ID NO: 213, 217, 218, or 524, or a sequence of amino acids that has at least 90% sequence identity thereto, such as a sequence having at least at or about 90, 91, 92, 93, 94, 95, 96, 97, 98, or 99% identity with such a sequence. In some aspects, the Cβ region contains the amino acid sequence set forth in SEQ ID NO: 214, 216, 631, or 889, or a sequence of amino acids that has at least 90% sequence identity thereto, such as a sequence having at least at or about 90, 91, 92, 93, 94, 95, 96, 97, 98, or 99% identity with such a sequence. In some embodiments, the Cα and/or Cβ regions are modified, for example, by incorporation of one or more non-native cysteine residues, such as any described herein. In some embodiments, the Cα region or portion thereof contains a non-native cysteine at residue 48 and comprises the amino acid sequence set forth in any of SEQ ID NOs: 196, 200, 201, 203, or 525, or a sequence of amino acids that has at least 90% sequence identity thereto, such as a sequence having at least at or about 90, 91, 92, 93, 94, 95, 96, 97, 98, or 99% identity with such a sequence and that contains the introduced non-native cysteine residue (e.g., Cys48). In some aspects, the Cβ region contains a non-native cysteine at residue 57 and contains the amino acid sequence set forth in SEQ ID NO: 197, 199, or 890, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 48, 58, 283, 687, 705, 722, 737, 755, 771, 783, 795, 811, 826, 841, 853, 865, 877, 891, 904, 921, 933, 947, 959, 971, 983, or 995, or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 52, 285, 62, 696, 714, 731, 746, 764, 777, 789, 804, 820, 835, 847, 859, 871, 883, 897, 913, 927, 941, 953, 965, 977, 989, or 1004, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 49, 59, 284, 688, 706, 723, 738, 756, 772, 784, 796, 812, 827, 842, 854, 866, 878, 892, 905, 922, 934, 948, 960, 972, 984, or 996, or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 53, 63, 286, 697, 715, 732, 747, 765, 778, 790, 805, 821, 836, 848, 860, 872, 884, 898, 914, 928, 942, 954, 966, 978, 990, or 1005, or a sequence of amino acids that has at least 90% sequence identity thereto, such as a sequence having at least at or about 90, 91, 92, 93, 94, 95, 96, 97, 98, or 99% identity with such a sequence.

In some embodiments, the Vα and Vβ regions contain the amino acid sequences corresponding to the SEQ ID NOs. set forth in Table 6 or Table 7. In some aspects, the TCR contains constant alpha and constant beta region sequences, such as those corresponding to the SEQ ID NOs. set forth in Table 6 or Table 7. In some cases, the TCR contains a full sequence comprising the variable and constant chain, such as a sequence corresponding to the SEQ ID NOs. set forth in Table 6 or Table 7 ("Full"). In some embodiments, the full sequence containing the variable and constant regions also includes a signal sequence and thus comprises a sequence corresponding to the SEQ ID NOs. set forth in Table 6 or Table 7 ("Full+signal"). Also among the provided TCRs are those containing sequences at least at or about 90, 91, 92, 93, 94, 95, 96, 97, 98, or 99% identical to such sequences. Exemplary TCRs containing such sequences, or their modified versions as described elsewhere herein, also are set forth in the Tables 6 and 7, respectively.

TABLE 6

HPV16 E7(11-19) TCR Native SEQ ID NOs.

| Exemplary TCR | Alpha | | | | Beta | | | |
|---|---|---|---|---|---|---|---|---|
| | Variable (Vα) | Constant | Full | Full + signal | Variable (Vβ) | Constant | Full | Full + signal |
| TCR 6 | 117 | 217 | 48 | 330 | 118, 296 | 216 | 52, 285 | 332, 246 |
| TCR 7 | 119 | 218 | 58 | 334 | 120 | 214 | 62 | 336 |
| TCR 12 | 295 | 213 | 283 | 222 | 118, 296 | 216 | 52, 285 | 332, 246 |
| TCR 31 | 691 | 213 | 687 | 689 | 700 | 216 | 696 | 698 |
| TCR 32 | 709 | 213 | 705 | 707 | 718 | 216 | 714 | 716 |
| TCR 33 | 726 | 213 | 722 | 724 | 735 | 216 | 731 | 733 |
| TCR 34 | 741 | 213 | 737 | 739 | 750 | 216 | 746 | 748 |
| TCR 35 | 759 | 213 | 755 | 757 | 768 | 216 | 764 | 766 |
| TCR 36 | 775 | 218 | 771 | 773 | 781 | 216 | 777 | 779 |
| TCR 37 | 787 | 213 | 783 | 785 | 793 | 214 | 789 | 791 |
| TCR 38 | 799 | 213 | 795 | 797 | 808 | 216 | 804 | 806 |
| TCR 39 | 815 | 213 | 811 | 813 | 824 | 214 | 820 | 822 |
| TCR 40 | 830 | 213 | 826 | 828 | 839 | 216 | 835 | 837 |
| TCR 41 | 845 | 213 | 841 | 843 | 851 | 216 | 847 | 849 |
| TCR 42 | 857 | 213 | 853 | 855 | 863 | 216 | 859 | 861 |
| TCR 43 | 869 | 213 | 865 | 867 | 875 | 216 | 871 | 873 |
| TCR 44 | 881 | 213 | 877 | 879 | 887 | 889 | 883 | 885 |
| TCR 45 | 895 | 213 | 891 | 893 | 901 | 216 | 897 | 899 |
| TCR 46 | 908 | 213 | 904 | 906 | 917 | 216 | 913 | 915 |
| TCR 47 | 925 | 524 | 921 | 923 | 931 | 216 | 927 | 929 |
| TCR 48 | 937 | 213 | 933 | 935 | 945 | 216 | 941 | 943 |
| TCR 49 | 951 | 213 | 947 | 949 | 957 | 216 | 953 | 955 |
| TCR 50 | 963 | 213 | 959 | 961 | 969 | 214 | 965 | 967 |
| TCR 51 | 975 | 213 | 971 | 973 | 981 | 214 | 977 | 979 |
| TCR 52 | 987 | 213 | 983 | 985 | 993 | 214 | 989 | 991 |
| TCR 53 | 999 | 213 | 995 | 997 | 1008 | 216 | 1004 | 1006 |
| TCR 54 | 119 | 218 | 58 | 334 | 120 | 214 | 62 | 336 |
| TCR 55 | 295 | 213 | 283 | 222 | 118, 296 | 216 | 52, 285 | 332, 246 |

TABLE 7

HPV16 E7(11-19) TCR Modified SEQ ID NOs.

| Exemplary modified version of TCR | Alpha | | | | Beta | | | |
|---|---|---|---|---|---|---|---|---|
| | Variable (Vα) | Constant | Full | Full + signal | Variable (Vβ) | Constant | Full | Full + signal |
| TCR 6 | 117 | 200 | 49 | 331 | 118, 296 | 199 | 53, 286 | 333, 250 |
| TCR 7 | 119 | 201 | 59 | 335 | 120 | 197 | 63 | 337 |

TABLE 7-continued

HPV16 E7(11-19) TCR Modified SEQ ID NOs.

| Exemplary modified version of TCR | Alpha | | | | Beta | | | |
|---|---|---|---|---|---|---|---|---|
| | Variable (Vα) | Constant | Full | Full + signal | Variable (Vβ) | Constant | Full | Full + signal |
| TCR 12 | 295 | 196 | 284 | 242 | 118, 296 | 199 | 53, 286 | 333, 250 |
| TCR 31 | 691 | 203 | 688 | 690 | 700 | 199 | 697 | 699 |
| TCR 32 | 709 | 203 | 706 | 708 | 718 | 199 | 715 | 717 |
| TCR 33 | 726 | 203 | 723 | 725 | 735 | 199 | 732 | 734 |
| TCR 34 | 741 | 203 | 738 | 740 | 750 | 199 | 747 | 749 |
| TCR 35 | 759 | 203 | 756 | 758 | 768 | 199 | 765 | 767 |
| TCR 36 | 775 | 201 | 772 | 774 | 781 | 199 | 778 | 780 |
| TCR 37 | 787 | 203 | 784 | 786 | 793 | 197 | 790 | 792 |
| TCR 38 | 799 | 203 | 796 | 798 | 808 | 199 | 805 | 807 |
| TCR 39 | 815 | 203 | 812 | 814 | 824 | 197 | 821 | 823 |
| TCR 40 | 830 | 203 | 827 | 829 | 839 | 199 | 836 | 838 |
| TCR 41 | 845 | 203 | 842 | 844 | 851 | 199 | 848 | 850 |
| TCR 42 | 857 | 203 | 854 | 856 | 863 | 199 | 860 | 862 |
| TCR 43 | 869 | 203 | 866 | 868 | 875 | 199 | 872 | 874 |
| TCR 44 | 881 | 203 | 878 | 880 | 887 | 890 | 884 | 886 |
| TCR 45 | 895 | 203 | 892 | 894 | 901 | 199 | 898 | 900 |
| TCR 46 | 908 | 203 | 905 | 907 | 917 | 199 | 914 | 916 |
| TCR 47 | 925 | 525 | 922 | 924 | 931 | 199 | 928 | 930 |
| TCR 48 | 937 | 203 | 934 | 936 | 945 | 199 | 942 | 944 |
| TCR 49 | 951 | 203 | 948 | 950 | 957 | 199 | 954 | 956 |
| TCR 50 | 963 | 203 | 960 | 962 | 969 | 197 | 966 | 968 |
| TCR 51 | 975 | 203 | 972 | 974 | 981 | 199 | 978 | 980 |
| TCR 52 | 987 | 203 | 984 | 986 | 993 | 199 | 990 | 992 |
| TCR 53 | 999 | 203 | 996 | 998 | 1008 | 199 | 1005 | 1007 |
| TCR 54 | 119 | 201 | 59 | 335 | 120 | 197 | 63 | 337 |
| TCR 55 | 295 | 196 | 284 | 242 | 118, 296 | 199 | 53, 286 | 333, 250 | c. HPV 16 E7(86-93)

In some cases, the TCR recognizes or binds a peptide epitope derived from HPV16 E7 that is or contains E7(86-93) TLGIVCPI (SEQ ID NO: 235). In some embodiments, the TCR recognizes or binds HPV 16 E7(86-93) in the context of an MHC, such as an MHC class I, e.g. HLA-A2.

In some embodiments, the Vα region contains a complementarity determining region 3 (CDR-3) comprising the amino acid sequence set forth in SEQ ID NO: 175. In some embodiments, the Vα region contains a CDR3 sequence at least at or about 90, 91, 92, 93, 94, 95, 96, 97, 98, or 99% identical to such sequences. In some aspects, the Vα region contains a complementarity determining region 1 (CDR-1) comprising the amino acid sequence set forth in SEQ ID NO: 142, or a sequence having at least at or about 90, 91, 92, 93, 94, 95, 96, 97, 98, or 99% identity with such a sequence. In some aspects, the Vα region comprises a complementarity determining region 2 (CDR-2) comprising the amino acid sequence set forth in SEQ ID NO: 143, or a sequence having at least at or about 90, 91, 92, 93, 94, 95, 96, 97, 98, or 99% identity with such a sequence.

In some embodiments, the Vβ region contains a complementarity determining region 3 (CDR-3) comprising the amino acid sequence set forth in SEQ ID NO: 178, or a sequence having at least at or about 90, 91, 92, 93, 94, 95, 96, 97, 98, or 99% identity with such a sequence. In some cases, the Vβ region contains a complementarity determining region 1 (CDR-1) comprising an amino acid sequence set forth in SEQ ID NO:176, or a sequence having at least at or about 90, 91, 92, 93, 94, 95, 96, 97, 98, or 99% identity with such a sequence. In some aspects, the Vβ region contains a complementarity determining region 2 (CDR-2) comprising an amino acid sequence set forth in SEQ ID NO: 177, or a sequence having at least at or about 90, 91, 92, 93, 94, 95, 96, 97, 98, or 99% identity with such a sequence.

In some embodiments, the Vα region contains a CDR-1, CDR-2, and CDR-3, comprising the amino acid sequences of SEQ ID NOs: 142, 143, and 175, respectively. In some such embodiments, the Vβ region contains a CDR-1, CDR-2, and CDR-3, comprising the amino acid sequences of SEQ ID NOs: 176, 177, and 178, respectively. Also among the provided TCRs are those having sequences at least at or about 90, 91, 92, 93, 94, 95, 96, 97, 98, or 99% identical to such sequences.

In some aspects, the Vα region contains a complementarity determining region 1 (CDR-1), a CDR-2, and a CDR-3, respectively comprising the CDR-1, CDR-2, and CDR-3 amino acid sequences contained within a Vα region amino acid sequence set forth in SEQ ID NO: 127. In some embodiments, the Vβ region contains a CDR-1, a CDR-2, and a CDR-3, respectively comprising the CDR-1, CDR-2, and CDR-3 amino acid sequences contained within a Vβ region amino acid sequence set forth in SEQ ID NO: 128. Also among the provided TCRs are those containing sequences at least at or about 90, 91, 92, 93, 94, 95, 96, 97, 98, or 99% identical to such sequences.

In some embodiments, the TCR or antigen-binding fragment includes a Vα region contains a complementarity determining region 1 (CDR-1), a CDR-2, and a CDR-3, respectively comprising the CDR-1, CDR-2, and CDR-3 amino acid sequences set forth in Table 8. and a Vβ region that contains a complementarity determining region 1 (CDR-1), a CDR-2, and a CDR-3, respectively comprising the CDR-1, CDR-2, and CDR-3 amino acid sequences set forth in Table 8. Also among the provided TCRs are those containing sequences at least at or about 90, 91, 92, 93, 94, 95, 96, 97, 98, or 99% identical to such sequences. Exemplary TCRs containing such CDRs, or their modified versions as described elsewhere herein, also are set forth in the Table 8.

TABLE 8

HPV16 E7(86-93) TCR CDR SEQ ID NOs.

| Exemplary | Alpha | | | Beta | | |
|---|---|---|---|---|---|---|
| TCR | CDR1 | CDR2 | CDR3 | CDR1 | CDR2 | CDR3 |
| TCR 11 | 142 | 143 | 175 | 176 | 177 | 178 |

In some embodiments, the TCR or antigen-binding fragment thereof contains Vα and Vβ regions comprise the amino acid sequences of SEQ ID NOs: 127 and 128, respectively. Also among the provided TCRs are those containing sequences at least at or about 90, 91, 92, 93, 94, 95, 96, 97, 98, or 99% identical to such sequences.

In some embodiments, the alpha chain of the TCR or antigen-binding fragment thereof further contains a Cα region or portion thereof and/or the beta chain further contains a Cβ region or portion thereof. In some embodiments, the Cα region or portion thereof comprises the amino acid sequence set forth in any of SEQ ID NO: 212, 213 or 217, or a sequence of amino acids that has at least 90% sequence identity thereto, such as a sequence having at least at or about 90, 91, 92, 93, 94, 95, 96, 97, 98, or 99% identity with such a sequence. In some aspects, the Cβ region contains the amino acid sequence set forth in SEQ ID NO: 214, or 216, or a sequence of amino acids that has at least 90% sequence identity thereto, such as a sequence having at least at or about 90, 91, 92, 93, 94, 95, 96, 97, 98, or 99% identity with such a sequence. In some embodiments, the Cα and/or Cβ regions are modified, for example, by incorporation of one or more non-native cysteine residues, such as any described herein. In some embodiments, the Cα region or portion thereof contains a non-native cysteine at residue 48 and comprises the amino acid sequence set forth in SEQ ID NO: 200, or a sequence of amino acids that has at least 90% sequence identity thereto, such as a sequence having at least at or about 90, 91, 92, 93, 94, 95, 96, 97, 98, or 99% identity with such a sequence and that contains the introduced non-native cysteine residue (e.g. Cys48). In some aspects, the Cβ region contains a non-native cysteine at residue 57 and contains the amino acid sequence set forth in SEQ ID NO: 197 or 199, or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 98 or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 102 or a sequence of amino acids that has at least 90% sequence identity thereto, such as a sequence having at least at or about 90, 91, 92, 93, 94, 95, 96, 97, 98, or 99% identity with such a sequence.

In some embodiments, the TCR or antigen-binding fragment thereof comprises an alpha chain comprising the sequence of amino acids set forth in SEQ ID NO: 99 or a sequence of amino acids that has at least 90% sequence identity thereto, such as a sequence having at least at or about 90, 91, 92, 93, 94, 95, 96, 97, 98, or 99% identity with such a sequence and/or a beta chain comprising the sequence of amino acids set forth in SEQ ID NO: 103 or a sequence of amino acids that has at least 90% sequence identity thereto, such as a sequence having at least at or about 90, 91, 92, 93, 94, 95, 96, 97, 98, or 99% identity with such a sequence.

In some embodiments, the Vα and Vβ regions contain the amino acid sequences corresponding to the SEQ ID NOs. set forth in Table 9 or Table 10. In some aspects, the TCR contains constant alpha and constant beta region sequences, such as those corresponding to the SEQ ID NOs. set forth in Table 9 or Table 10. In some cases, the TCR contains a full sequence comprising the variable and constant chain, such as a sequence corresponding to the SEQ ID NOs. set forth in Table 9 or Table 10 ("Full"). In some embodiments, the full sequence containing the variable and constant regions also includes a signal sequence and thus comprises a sequence corresponding to the SEQ ID NOs. set forth in Table 9 or Table 10 ("Full+signal"). Also among the provided TCRs are those containing sequences at least at or about 90, 91, 92, 93, 94, 95, 96, 97, 98, or 99% identical to such sequences. Exemplary TCRs containing such sequences, or their modified versions as described elsewhere herein, also are set forth in the Tables 9 and 10, respectively.

TABLE 9

HPV16 E7(86-93) TCR Native SEQ ID NOs.

| Exemplary TCR | Alpha | | | | Beta | | | |
|---|---|---|---|---|---|---|---|---|
| | Variable (Vα) | Constant | Full | Full + signal | Variable (Vβ) | Constant | Full | Full + signal |
| TCR 11 | 127 | 217 | 98 | 195 | 128 | 216 | 102 | 352 |

TABLE 10

HPV16 E7(86-93) TCR Modified SEQ ID NOs.

| Exemplary modified version of TCR | Alpha | | | | Beta | | | |
|---|---|---|---|---|---|---|---|---|
| | Variable (Vα) | Constant | Full | Full + signal | Variable (Vβ) | Constant | Full | Full + signal |
| TCR 11 | 127 | 200 | 99 | 205 | 128 | 199 | 103 | 221 |

2. Variants & Modifications

In some embodiments, the binding molecule, e.g., TCR or antigen-binding fragment thereof, is or has been modified. In certain embodiments, the binding molecules, e.g., TCRs or antigen-binding fragments thereof, include one or more amino acid variations, e.g., substitutions, deletions, insertions, and/or mutations, compared to the sequence of a binding molecule, e.g., TCR, described herein. Exemplary variants include those designed to improve the binding affinity and/or other biological properties of the binding molecule. Amino acid sequence variants of a binding molecule may be prepared by introducing appropriate modifications into the nucleotide sequence encoding the binding molecule, or by peptide synthesis. Such modifications include, for example, deletions from, and/or insertions into and/or substitutions of residues within the amino acid sequences of the binding molecule. Any combination of deletion, insertion, and substitution can be made to arrive at the final construct, provided that the final construct possesses the desired characteristics, e.g., antigen-binding.

In some embodiments, directed evolution methods are used to generate TCRs with altered properties, such as with higher affinity for a specific peptide in the context of an MHC molecule. In some embodiments, directed evolution is achieved by display methods including, but not limited to, yeast display (Holler et al. (2003) Nat Immunol, 4, 55-62; Holler et al. (2000) Proc Natl Acad Sci USA, 97, 5387-92), phage display (Li et al. (2005) Nat Biotechnol, 23, 349-54), or T cell display (Chervin et al. (2008) J Immunol Methods, 339, 175-84). In some embodiments, display approaches involve engineering, or modifying, a known, parent or reference TCR. For example, in some cases, a reference TCR, such as any provided herein, can be used as a template for producing mutagenized TCRs in which in one or more residues of the CDRs are mutated, and mutants with an desired altered property, such as higher affinity for peptide epitope in the context of an MHC molecule, are selected.

In certain embodiments, the binding molecules, e.g., TCRs or antigen-binding fragments thereof, include one or more amino acid substitutions, e.g., as compared to a binding molecule, e.g., TCR, sequence described herein and/or compared to a sequence of a natural repertoire, e.g., human repertoire. Sites of interest for substitutional mutagenesis include the CDRs, FRs and/or constant regions. Amino acid substitutions may be introduced into a binding molecule of interest and the products screened for a desired activity, e.g., retained/improved antigen affinity or avidity, decreased immunogenicity, improved half-life, CD8-independent binding or activity, surface expression, promotion of TCR chain pairing and/or other improved properties or functions.

In some embodiments, one or more residues within a CDR of a parent binding molecule, e.g., TCR, is/are substituted. In some embodiments, the substitution is made to revert a sequence or position in the sequence to a germline sequence, such as a binding molecule sequence found in the germline (e.g., human germline), for example, to reduce the likelihood of immunogenicity, e.g., upon administration to a human subject.

In certain embodiments, substitutions, insertions, or deletions may occur within one or more CDRs so long as such alterations do not substantially reduce the ability of the binding molecule, e.g., TCR or antigen-binding fragment thereof, to bind antigen. For example, conservative alterations (e.g., conservative substitutions as provided herein) that do not substantially reduce binding affinity may be made in CDRs. Such alterations may, for example, be outside of antigen contacting residues in the CDRs. In certain embodiments of the variable sequences provided herein, each CDR either is unaltered, or contains no more than one, two or three amino acid substitutions.

Amino acid sequence insertions include amino- and/or carboxyl-terminal fusions ranging in length from one residue to polypeptides containing a hundred or more residues, as well as intrasequence insertions of single or multiple amino acid residues.

In some aspects, the TCR or antigen-binding fragment thereof may contain one or more modifications in the alpha chain and/or beta chain such that when the TCR or antigen-binding fragment thereof is expressed in a cell, the frequency of mis-pairing between the TCR alpha chain and beta chain and an endogenous TCR alpha chain and beta chain is reduced, the expression of the TCR alpha chain and beta chain is increased, and/or the stability of the TCR alpha chain and beta chain is increased.

In some embodiments, the TCR contains one or more non-native cysteine residues to introduce a covalent disulfide bond linking a residue of the immunoglobulin region of the constant domain of the α chain to a residue of the immunoglobulin region of the constant domain of the β chain. In some embodiments, one or more cysteines can be incorporated into the constant region extracellular sequences of the first and second segments of the TCR polypeptide. Exemplary non-limiting modifications in a TCR to introduce a non-native cysteine residues are described herein (see also, International PCT No. WO2006/000830 and WO2006037960). In some cases, both a native and a non-native disulfide bond may be desirable. In some embodiments, the TCR or antigen-binding fragment is modified such that the interchain disulfide bond in a native TCR is not present.

In some embodiments, the transmembrane domain of the constant region of the TCR can be modified to contain a greater number of hydrophobic residues (see e.g. Haga-Friedman et al. (2012) Journal of Immunology, 188:5538-5546). In some embodiments, the tranmembrane region of TCR α chain contains one or more mutations corresponding to S116L, G119V or F120L, with reference to numbering of a Cα set forth in any of SEQ ID NOS: 212, 213, 215, 217, 220, or 524.

In some embodiments, the cell expressing the TCR further includes a marker, such as a cell surface marker, which may be used to confirm transduction or engineering of the cell to express the TCR, such as a truncated version of a cell surface receptor, such as truncated EGFR (tEGFR). In some aspects, the marker includes all or part (e.g., truncated form) of CD34, a NGFR, or epidermal growth factor receptor (e.g., tEGFR). In some embodiments, the nucleic acid encoding the marker is operably linked to a polynucleotide encoding for a linker sequence, such as a cleavable linker sequence, e.g., T2A. See WO2014031687. In some embodiments, introduction of a construct encoding the TCR and EGFRt separated by a T2A, P2A or other ribosome switch can express two proteins from the same construct, such that the EGFRt can be used as a marker to detect cells expressing such construct. Exemplary of such markers that can be used are described below.

In some embodiments, the TCR or antigen-binding fragment thereof is encoded by a nucleotide sequence that is or has been codon-optimized. Exemplary codon-optimized variants are described elsewhere herein.

B. Antibodies

In some embodiments, the binding molecule is an antibody or antigen-binding fragment thereof that contains any one or more of the CDRs as described above with respect to TCRs.

In some embodiments, the antibody or antigen-binding fragment contains variable heavy and light chain containing a CDR1, CDR2 and/or CDR3 contained in the alpha chain and a CDR1, CDR2 and/or CDR3 contained in the beta chain as set forth in Table 2, Table 5, or Table 8. Also among the provided antibodies or antigen-binding fragments are those containing sequences at least at or about 90, 91, 92, 93, 94, 95, 96, 97, 98, or 99% identical to such sequences.

In some embodiments, the antibody or antigen-binding fragment contains a variable region that contains a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 111, 113, 115, 121, 123 125, 297, 299, 477, 492, 504, 510, 522, 536, 554, 569, 587, 599, 611, 623, 637, 649, 661, or 676. In some aspects, the antibody or antigen-binding fragment contains a variable region that contains a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 112, 114, 116, 122, 124 126, 298, 300, 483, 498, 498, 516, 530, 545, 560, 578, 593, 605, 617, 629, 643, 655, 667, or 685. Also among the provided antibodies or antigen-bind fragments are those containing sequences at least at or about 90, 91, 92, 93, 94, 95, 96, 97, 98, or 99% identical to such sequences.

In some embodiments, the provided antibody or antibody fragment is a human antibody. In some embodiments, the provided antibody or antibody fragment contains a $V_H$ region that contains a portion having at least 95%, 96%, 97%, 98%, 99%, or 100% sequence identity to an amino acid sequence encoded by a germline nucleotide human heavy chain V segment, a portion with at least 95%, 96%, 97%, 98%, 99%, or 100% identity to an amino acid sequence encoded by a germline nucleotide human heavy chain D segment, and/or a portion having at least 95%, 96%, 97%, 98%, 99%, or 100% identity to an amino acid sequence encoded by a germline nucleotide human heavy chain J segment; and/or contains a $V_L$ region that contains a portion with at least 95%, 96%, 97%, 98%, 99%, or 100% identity to an amino acid sequence encoded by a germline nucleotide human kappa or lambda chain V segment, and/or a portion with at least 95%, 96%, 97%, 98%, 99%, or 100% identity to an amino acid sequence encoded by a germline nucleotide human kappa or lambda chain J segment. In some embodiments, the portion of the $V_H$ region corresponds to the CDR-H1, CDR-H2 and/or CDR-H3. In some embodiments, the portion of the $V_H$ region corresponds to the framework region 1 (FR1), FR2, FR2 and/or FR4. In some embodiments, the portion of the $V_L$ region corresponds to the CDR-L1, CDR-L2 and/or CDR-L3. In some embodiments, the portion of the $V_L$ region corresponds to the FR1, FR2, FR2 and/or FR4.

In some embodiments, the antibody or antigen-binding fragment contains a framework region that contains human germline gene segment sequences. For example, in some embodiments, the antibody or antigen-binding fragment contains a $V_H$ region in which the framework region, e.g. FR1, FR2, FR3 and FR4, has at least 95%, 96%, 97%, 98%, 99%, or 100% sequence identity to a framework region encoded by a human germline antibody segment, such as a V and/or a segment. In some embodiments, the human antibody contains a $V_L$ region in which the framework region e.g. FR1, FR2, FR3 and FR4, has at least 95%, 96%, 97%, 98%, 99%, or 100% sequence identity to a framework region encoded by a human germline antibody segment, such as a V and/or segment. For example, in some such embodiments, the framework sequence of the $V_H$ and/or $V_L$ sequence differs by no more than 10 amino acids, such as no more than 9, 8, 7, 6, 5, 4, 3, 2 or 1 amino acid, compared to the framework region encoded by a human germline antibody segment. In some embodiments, the antibodies and antigen binding fragments thereof, e.g. TCR-like antibodies, specifically recognize a peptide epitope in the context of an MHC molecule, such as an MHC class I. In some cases, the MHC class I molecule is an HLA-A2 molecule, e.g. HLA-A2*01.

In some embodiments, the antibody or antigen-binding fragment thereof recognizes or binds to an epitope or region of HPV16 E6, such as a peptide epitope containing an amino acid sequence set forth in any of SEQ ID NOs: 232-234. In some instances, the TCR or antigen-binding fragment thereof that recognizes or binds a peptide epitope derived from HPV16 E6 is or comprises the sequence set forth in SEQ ID NO: 233.

In some aspects, the TCR or antigen-binding fragment recognizes or binds to an epitope or region of HPV16 E7 protein, such as a peptide epitope containing an amino acid sequence set forth in any of SEQ ID NOs: 235-239. In some embodiments, the TCR or antigen-binding fragment thereof does not recognize or bind the epitope E7 (11-19) comprising the amino acid sequence YMLDLQPET (SEQ ID NO. 236). In some cases, the peptide derived from HPV16 E7 is or contains the sequence set forth in SEQ ID NO: 235.

Thus, provided in some embodiments are anti-HPV antibodies, including functional antibody fragments. In some embodiments, the antibodies $V_H$ and/or $V_L$ domains, or antigen-binding site thereof, and are capable of specifically binding to a peptide epitope of HPV 16. In some embodiments, the antibodies include a variable heavy chain and a variable light chain, such as scFvs. The antibodies include antibodies that specifically bind to HPV, e.g., HPV 16 E6 or HPV 16 E7. Among the provided anti-HPV antibodies are human antibodies. The antibodies include isolated antibodies. Also provided are molecules containing such antibodies, e.g., single-chain proteins, fusion proteins, and/or recombinant receptors such as chimeric receptors, including antigen receptors.

The term "antibody" herein is used in the broadest sense and includes polyclonal and monoclonal antibodies, including intact antibodies and functional (antigen-binding) antibody fragments, including fragment antigen binding (Fab) fragments, F(ab')₂ fragments, Fab' fragments, Fv fragments, recombinant IgG (rIgG) fragments, variable heavy chain ($V_H$) regions capable of specifically binding the antigen, single chain antibody fragments, including single chain variable fragments (scFv), and single domain antibodies (e.g., sdAb, sdFv, nanobody) fragments. The term encompasses genetically engineered and/or otherwise modified forms of immunoglobulins, such as intrabodies, peptibodies, chimeric antibodies, fully human antibodies, humanized antibodies, and heteroconjugate antibodies, multispecific, e.g., bispecific, antibodies, diabodies, triabodies, and tetrabodies, tandem di-scFv, tandem tri-scFv. Unless otherwise stated, the term "antibody" should be understood to encompass functional antibody fragments thereof. The term also encompasses intact or full-length antibodies, including antibodies of any class or sub-class, including IgG and sub-classes thereof, IgM, IgE, IgA, and IgD.

In some embodiments, the heavy and light chains of an antibody can be full-length or can be an antigen-binding portion (a Fab, F(ab')2, Fv or a single chain Fv fragment (scFv)). In other embodiments, the antibody heavy chain constant region is chosen from, e.g., IgG1, IgG2, IgG3, IgG4, IgM, IgA1, IgA2, IgD, and IgE, particularly chosen from, e.g., IgG1, IgG2, IgG3, and IgG4, more particularly, IgG1 (e.g., human IgG1). In another embodiment, the antibody light chain constant region is chosen from, e.g., kappa or lambda, particularly kappa.

Among the provided antibodies are antibody fragments. An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')$_2$; diabodies; linear antibodies; variable heavy chain ($V_H$) regions, single-chain antibody molecules such as scFvs and single-domain $V_H$ single antibodies; and multispecific antibodies formed from antibody fragments. In particular embodiments, the antibodies are single-chain antibody fragments comprising a variable heavy chain region and/or a variable light chain region, such as scFvs.

The term "variable region" or "variable domain", when used in reference to an antibody, such as an antibody fragment, refers to the domain of an antibody heavy or light chain that is involved in binding the antibody to antigen. The variable domains of the heavy chain and light chain ($V_H$ and $V_L$, respectively) of a native antibody generally have similar structures, with each domain comprising four conserved framework regions (FRs) and three CDRs. (See, e.g., Kindt et al. Kuby Immunology, 6th ed., W.H. Freeman and Co., page 91 (2007). A single $V_H$ or $V_L$ domain may be sufficient to confer antigen-binding specificity. Furthermore, antibodies that bind a particular antigen may be isolated using a $V_H$ or $V_L$ domain from an antibody that binds the antigen to screen a library of complementary $V_L$ or $V_H$ domains, respectively. See, e.g., Portolano et al., J. Immunol. 150: 880-887 (1993); Clarkson et al., Nature 352:624-628 (1991).

Single-domain antibodies are antibody fragments comprising all or a portion of the heavy chain variable domain or all or a portion of the light chain variable domain of an antibody. In certain embodiments, a single-domain antibody is a human single-domain antibody.

Antibody fragments can be made by various techniques, including but not limited to proteolytic digestion of an intact antibody as well as production by recombinant host cells. In some embodiments, the antibodies are recombinantly-produced fragments, such as fragments comprising arrangements that do not occur naturally, such as those with two or more antibody regions or chains joined by synthetic linkers, e.g., peptide linkers, and/or that are may not be produced by enzyme digestion of a naturally-occurring intact antibody. In some aspects, the antibody fragments are scFvs.

Among the provided anti-HPV antibodies are human antibodies. A "human antibody" is an antibody with an amino acid sequence corresponding to that of an antibody produced by a human or a human cell, or non-human source that utilizes human antibody repertoires or other human antibody-encoding sequences, including human antibody libraries. The term excludes humanized forms of non-human antibodies comprising non-human antigen-binding regions, such as those in which all or substantially all CDRs are non-human. The term includes antigen-binding fragments of human antibodies.

A "humanized" antibody is an antibody in which all or substantially all CDR amino acid residues are derived from non-human CDRs and all or substantially all FR amino acid residues are derived from human FRs. A humanized antibody optionally may include at least a portion of an antibody constant region derived from a human antibody. A "humanized form" of a non-human antibody, refers to a variant of the non-human antibody that has undergone humanization, typically to reduce immunogenicity to humans, while retaining the specificity and affinity of the parental non-human antibody. In some embodiments, some FR residues in a humanized antibody are substituted with corresponding residues from a non-human antibody (e.g., the antibody from which the CDR residues are derived), e.g., to restore or improve antibody specificity or affinity.

Human antibodies may be prepared by administering an immunogen to a transgenic animal that has been modified to produce intact human antibodies or intact antibodies with human variable regions in response to antigenic challenge. Such animals typically contain all or a portion of the human immunoglobulin loci, which replace the endogenous immunoglobulin loci, or which are present extrachromosomally or integrated randomly into the animal's chromosomes. In such transgenic animals, the endogenous immunoglobulin loci have generally been inactivated. Human antibodies also may be derived from human antibody libraries, including phage display and cell-free libraries, containing antibody-encoding sequences derived from a human repertoire.

Among the provided antibodies are monoclonal antibodies, including monoclonal antibody fragments. The term "monoclonal antibody" as used herein refers to an antibody obtained from or within a population of substantially homogeneous antibodies, i.e., the individual antibodies comprising the population are identical, except for possible variants containing naturally occurring mutations or arising during production of a monoclonal antibody preparation, such variants generally being present in minor amounts. In contrast to polyclonal antibody preparations, which typically include different antibodies directed against different epitopes, each monoclonal antibody of a monoclonal antibody preparation is directed against a single epitope on an antigen. The term is not to be construed as requiring production of the antibody by any particular method. A monoclonal antibody may be made by a variety of techniques, including but not limited to generation from a hybridoma, recombinant DNA methods, phage-display and other antibody display methods.

As used herein, reference to a "corresponding form" of an antibody means that when comparing a property or activity of two antibodies, the property is compared using the same form of the antibody. For example, if it is stated that an antibody has greater activity compared to the activity of the corresponding form of a first antibody, that means that a particular form, such as a scFv of that antibody, has greater activity compared to the scFv form of the first antibody.

"Effector functions" refer to those biological activities attributable to the Fc region of an antibody, which vary with the antibody isotype. Examples of antibody effector functions include: C1q binding and complement dependent cytotoxicity (CDC); Fc receptor binding; antibody-dependent cell-mediated cytotoxicity (ADCC); phagocytosis; down regulation of cell surface receptors (e.g. B cell receptor); and B cell activation.

In some embodiments, the antibody, e.g., antibody fragment, may contain at least a portion of an immunoglobulin constant region, such as one or more constant region domain. In some embodiments, the constant regions include a light chain constant region and/or a heavy chain constant region 1 (CH1). In some embodiments, the antibody includes a CH2 and/or CH3 domain, such as an Fc region. In some embodiments, the Fc region is an Fc region of a human IgG, such as an IgG1 or IgG4.

The term "Fc region" herein is used to define a C-terminal region of an immunoglobulin heavy chain that contains at least a portion of the constant region. The term includes native sequence Fc regions and variant Fc regions. In one embodiment, a human IgG heavy chain Fc region extends from Cys226, or from Pro230, to the carboxyl-terminus of the heavy chain. However, the C-terminal lysine (Lys447) of the Fc region may or may not be present. Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, Md., 1991.

The terms "full length antibody," "intact antibody," and "whole antibody" are used herein interchangeably to refer to an antibody having a structure substantially similar to a native antibody structure or having heavy chains that contain an Fc region as defined herein.

An "isolated" antibody is one which has been separated from a component of its natural environment. In some embodiments, an antibody is purified to greater than 95% or 99% purity as determined by, for example, electrophoretic (e.g., SDS-PAGE, isoelectric focusing (IEF), capillary electrophoresis) or chromatographic (e.g., ion exchange or reverse phase HPLC). For review of methods for assessment of antibody purity, see, e.g., Flatman et al., J. Chromatogr. B 848:79-87 (2007).

1. Variants and Modifications

In certain embodiments, the antibodies or antigen-binding fragments thereof include one or more amino acid variations, e.g., substitutions, deletions, insertions, and/or mutations, compared to the sequence of an antibody described herein. Exemplary variants include those designed to improve the binding affinity and/or other biological properties of the antibody.

Amino acid sequence variants of an antibody may be prepared by introducing appropriate modifications into the nucleotide sequence encoding the antibody, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen-binding.

In certain embodiments, the antibodies include one or more amino acid substitutions, e.g., as compared to an antibody sequence described herein and/or compared to a sequence of a natural repertoire, e.g., human repertoire. Sites of interest for substitutional mutagenesis include the CDRs and FRs. Amino acid substitutions may be introduced into an antibody of interest and the products screened for a desired activity, e.g., retained/improved antigen binding, decreased immunogenicity, improved half-life, and/or improved effector function, such as the ability to promote antibody-dependent cellular cytotoxicity (ADCC) or complement-dependent cytotoxicity (CDC).

In some embodiments, one or more residues within a CDR of a parent antibody (e.g. a humanized or human antibody) is/are substituted. In some embodiments, the substitution is made to revert a sequence or position in the sequence to a germline sequence, such as an antibody sequence found in the germline (e.g., human germline), for example, to reduce the likelihood of immunogenicity, e.g., upon administration to a human subject.

In some embodiments, alterations are made in CDR "hotspots," residues encoded by codons that undergo mutation at high frequency during the somatic maturation process (see, e.g., Chowdhury, Methods Mol. Biol. 207:179-196 (2008)), and/or residues that contact antigen, with the resulting variant $V_H$ or $V_L$ being tested for binding affinity. Affinity maturation by constructing and reselecting from secondary libraries has been described, e.g., in Hoogenboom et al. in Methods in Molecular Biology 178:1-37 (O'Brien et al., ed., Human Press, Totowa, N.J., (2001)). In some embodiments of affinity maturation, diversity is introduced into the variable genes chosen for maturation by any of a variety of methods (e.g., error-prone PCR, chain shuffling, or oligonucleotide-directed mutagenesis). A secondary library may then be created and screened to identify any antibody variants with the desired affinity. Another method to introduce diversity involves CDR-directed approaches, in which several CDR residues (e.g., 4-6 residues at a time) are randomized. CDR residues involved in antigen binding may be specifically identified, e.g., using alanine scanning mutagenesis or modeling. CDR-H3 and CDR-L3 in particular are often targeted.

In certain embodiments, substitutions, insertions, or deletions may occur within one or more CDRs so long as such alterations do not substantially reduce the ability of the antibody to bind antigen. For example, conservative alterations (e.g., conservative substitutions as provided herein) that do not substantially reduce binding affinity may be made in CDRs. Such alterations may, for example, be outside of antigen contacting residues in the CDRs. In certain embodiments of the variant $V_H$ and $V_L$ sequences provided above, each CDR either is unaltered, or contains no more than one, two or three amino acid substitutions.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion to the N- or C-terminus of the antibody to an enzyme or a polypeptide which increases the serum half-life of the antibody.

In certain embodiments, the antibody or antigen-binding fragment thereof is altered to increase or decrease the extent to which the antibody is glycosylated, for example, by removing or inserting one or more glycosylation sites by altering the amino acid sequence and/or by modifying the oligosaccharide(s) attached to the glycosylation sites, e.g., using certain cell lines.

Exemplary modifications, variants, and cell lines are described, e.g., in Patent Publication Nos. US 2003/0157108, US 2004/0093621, US 2003/0157108; WO 2000/61739; WO 2001/29246; US 2003/0115614; US 2002/0164328; US 2004/0093621; US 2004/0132140; US 2004/0110704; US 2004/0110282; US 2004/0109865; WO 2003/085119; WO 2003/084570; WO 2005/035586; WO 2005/035778; WO2005/053742; WO2002/031140; Okazaki et al. J. Mol. Biol. 336:1239-1249 (2004); Yamane-Ohnuki et al. Biotech. Bioeng. 87: 614 (2004). Ripka et al. Arch. Biochem. Biophys. 249:533-545 (1986); US Pat Appl No US 2003/0157108 A1, Presta, L; and WO 2004/056312 A1, Yamane-Ohnuki et al. Biotech. Bioeng. 87: 614 (2004); Kanda, Y. et al., Biotechnol. Bioeng., 94(4):680-688 (2006); and WO2003/085107); WO 2003/011878 (Jean-Mairet et al.); U.S. Pat. No. 6,602,684 (Umana et al.); and US 2005/ 0123546 (Umana et al.); WO 1997/30087 (Patel et al.); WO 1998/58964 (Raju, S.); and WO 1999/22764 (Raju, S.).

Among the modified antibodies are those having one or more amino acid modifications in the Fc region, such as those having a human Fc region sequence or other portion of a constant region (e.g., a human IgG1, IgG2, IgG3 or IgG4 Fc region) comprising an amino acid modification (e.g., a substitution) at one or more amino acid positions.

Such modifications can be made, e.g., to improve half-life, alter binding to one or more types of Fc receptors, and/or alter effector functions.

Also among the variants are cysteine engineered antibodies such as "thioMAbs" and other cysteine engineered variants, in which one or more residues of an antibody are substituted with cysteine residues, in order to generate reactive thiol groups at accessible sites, e.g., for use in conjugation of agents and linker-agents, to produce immunoconjugates. Cysteine engineered antibodies are described, e.g., in U.S. Pat. Nos. 7,855,275 and 7,521,541.

In some embodiments, the antibodies are modified to contain additional nonproteinaceous moieties, including water soluble polymers. Exemplary polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone) polyethylene glycol, propropylene glycol homopolymers, prolypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antibody may vary, and if more than one polymer is attached, they can be the same or different molecules. In general, the number and/or type of polymers used for derivatization can be determined based on considerations including, but not limited to, the particular properties or functions of the antibody to be improved, whether the antibody derivative will be used in a therapy under defined conditions, etc.

2 TCR-Like CARs

In some embodiments, the antibody or antigen-binding portion thereof is expressed on cells as part of a recombinant receptor, such as an antigen receptor. Among the antigen receptors are functional non-TCR antigen receptors, such as chimeric antigen receptors (CARs). Generally, a CAR containing an antibody or antigen-binding fragment that exhibits TCR-like specificity directed against a peptide in the context of an MHC molecule also may be referred to as a TCR-like CAR.

Thus, among the provided binding molecules, e.g., HPV 16 E6 or E7 binding molecules, are antigen receptors, such as those that include one of the provided antibodies, e.g., TCR-like antibodies. In some embodiments, the antigen receptors and other chimeric receptors specifically bind to a region or epitope of HPV16 E6 or E7, such as antigen receptors containing the provided anti-HPV 16 E6 or E7 antibodies or antibody fragments, e.g. TCR-like antibodies. Among the antigen receptors are functional non-TCR antigen receptors, such as chimeric antigen receptors (CARs). Also provided are cells expressing the CARs and uses thereof in adoptive cell therapy, such as treatment of diseases and disorders associated with HPV 16 E6 or E7 expression.

Thus, provided herein are TCR-like CARs that contain a non-TCR molecule that exhibits T cell receptor specificity, such as for a T cell epitope or peptide epitope when displayed or presented in the context of an MHC molecule. In some embodiments, a TCR-like CAR can contain an antibody or antigen-binding portion thereof, e.g., TCR-like antibody, such as described herein. In some embodiments, the antibody or antibody-binding portion thereof is reactive against specific peptide epitope in the context of an MHC molecule, wherein the antibody or antibody fragment can differentiate the specific peptide in the context of the MHC molecule from the MHC molecule alone, the specific peptide alone, and, in some cases, an irrelevant peptide in the context of an MHC molecule. In some embodiments, an antibody or antigen-binding portion thereof can exhibit a higher binding affinity than a T cell receptor.

Exemplary antigen receptors, including CARs, and methods for engineering and introducing such receptors into cells, include those described, for example, in international patent application publication numbers WO2000/14257, WO2013/126726, WO2012/129514, WO2014/031687, WO2013/166321, WO2013/071154, WO2013/123061 U.S. patent application publication numbers US2002/131960, US2013/287748, US2013/0149337, U.S. Pat. Nos. 6,451, 995, 7,446,190, 8,252,592, 8,339,645, 8,398,282, 7,446,179, 6,410,319, 7,070,995, 7,265,209, 7,354,762, 7,446,191, 8,324,353, and 8,479,118, and European patent application number EP2537416, and/or those described by Sadelain et al., Cancer Discov. 2013 April; 3(4): 388-398; Davila et al. (2013) PLoS ONE 8(4): e61338; Turtle et al., Curr. Opin. Immunol., 2012 October; 24(5): 633-39; Wu et al., Cancer, 2012 Mar. 18(2): 160-75. In some aspects, the antigen receptors include a CAR as described in U.S. Pat. No. 7,446,190, and those described in International Patent Application Publication No.: WO2014/055668 A1. Exemplary of the CARs include CARs as disclosed in any of the aforementioned publications, such as WO2014/031687, U.S. Pat. Nos. 8,339,645, 7,446,179, US 2013/0149337, U.S. Pat. Nos. 7,446,190, 8,389,282, e.g., and in which the antigen-binding portion, e.g., scFv, is replaced by an antibody, e.g., as provided herein.

In some embodiments, the CARs generally include an extracellular antigen (or ligand) binding domain, including as an antibody or antigen-binding fragment thereof specific for a peptide in the context of an MHC molecule, linked to one or more intracellular signaling components, in some aspects via linkers and/or transmembrane domain(s). In some embodiments, such molecules can typically mimic or approximate a signal through a natural antigen receptor, such as a TCR, and, optionally, a signal through such a receptor in combination with a costimulatory receptor.

In some embodiments, the CAR typically includes in its extracellular portion one or more antigen binding molecules, such as one or more antigen-binding fragment, domain, or portion, or one or more antibody variable domains, and/or antibody molecules. In some embodiments, the CAR includes an antigen-binding portion or portions of an antibody molecule, such as a single-chain antibody fragment (scFv) derived from the variable heavy (VH) and variable light (VL) chains of a monoclonal antibody (mAb). In some embodiments, the CAR contains a TCR-like antibody, such as an antibody or an antigen-binding fragment (e.g., scFv) that specifically recognizes a peptide epitope presented on the cell surface in the context of an MHC molecule.

In some aspects, the antigen-specific binding, or recognition component is linked to one or more transmembrane and intracellular signaling domains. In some embodiments, the CAR includes a transmembrane domain fused to the extracellular domain of the CAR. In one embodiment, the transmembrane domain that naturally is associated with one of the domains in the CAR is used. In some instances, the transmembrane domain is selected or modified by amino acid substitution to avoid binding of such domains to the transmembrane domains of the same or different surface membrane proteins to minimize interactions with other members of the receptor complex.

The transmembrane domain in some embodiments is derived either from a natural or from a synthetic source. Where the source is natural, the domain in some aspects is derived from any membrane-bound or transmembrane protein. Transmembrane regions include those derived from (i.e. comprise at least the transmembrane region(s) of) the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154. Alternatively the transmembrane domain in some embodiments is synthetic. In some aspects, the synthetic transmembrane domain comprises predominantly hydrophobic residues such as leucine and valine. In some aspects, a triplet of phenylalanine, tryptophan and valine will be found at each end of a synthetic transmembrane domain.

In some embodiments, a short oligo- or polypeptide linker, for example, a linker of between 2 and 10 amino acids in length, such as one containing glycines and serines, e.g., glycine-serine doublet, is present and forms a linkage between the transmembrane domain and the cytoplasmic signaling domain of the CAR.

In some embodiments, the CAR, e.g., TCR-like CAR, such as the antibody portion thereof, further includes a spacer, which may be or include at least a portion of an immunoglobulin constant region or variant or modified version thereof, such as a hinge region, e.g., an IgG4 hinge region, and/or a CH1/CL and/or Fc region. In some embodiments, the constant region or portion is of a human IgG, such as IgG4 or IgG1. In some aspects, the portion of the constant region serves as a spacer region between the antigen-recognition component, e.g., scFv, and transmembrane domain. The spacer can be of a length that provides for increased responsiveness of the cell following antigen binding, as compared to in the absence of the spacer. In some examples, the spacer is at or about 12 amino acids in length or is no more than 12 amino acids in length. Exemplary spacers include those having at least about 10 to 229 amino acids, about 10 to 200 amino acids, about 10 to 175 amino acids, about 10 to 150 amino acids, about 10 to 125 amino acids, about 10 to 100 amino acids, about 10 to 75 amino acids, about 10 to 50 amino acids, about 10 to 40 amino acids, about 10 to 30 amino acids, about 10 to 20 amino acids, or about 10 to 15 amino acids, and including any integer between the endpoints of any of the listed ranges. In some embodiments, a spacer region has about 12 amino acids or less, about 119 amino acids or less, or about 229 amino acids or less. Exemplary spacers include IgG4 hinge alone, IgG4 hinge linked to CH2 and CH3 domains, or IgG4 hinge linked to the CH3 domain. Exemplary spacers include, but are not limited to, those described in Hudecek et al. (2013) Clin. Cancer Res., 19:3153 or international patent application publication number WO2014/031687.

In some embodiments, the constant region or portion is of a human IgG, such as IgG4 or IgG1. In some embodiments, the spacer has the sequence ESKYGPPCPPCP (set forth in SEQ ID NO: 268), and is encoded by the sequence set forth in SEQ ID NO: 269. In some embodiments, the spacer has the sequence set forth in SEQ ID NO: 270. In some embodiments, the spacer has the sequence set forth in SEQ ID NO: 271. In some embodiments, the constant region or portion is of IgD. In some embodiments, the spacer has the sequence set forth in SEQ ID NO: 272. In some embodiments, the spacer has a sequence of amino acids that exhibits at least 85%, 86%, 87%, 88%, 89%, 90%, 91%, 92%, 93%, 94%, 95%, 96%, 97%, 98%, 99% or more sequence identity to any of SEQ ID NOS: 268, 270, 271, or 272.

The antigen recognition domain generally is linked to one or more intracellular signaling components, such as signaling components that mimic activation through an antigen receptor complex, such as a TCR complex, in the case of a CAR, and/or signal via another cell surface receptor. Thus, in some embodiments, the antibody or antigen-binding fragment thereof is linked to one or more transmembrane and intracellular signaling domains. In some embodiments, the transmembrane domain is fused to the extracellular domain. In one embodiment, a transmembrane domain that naturally is associated with one of the domains in the receptor, e.g., CAR, is used. In some instances, the transmembrane domain is selected or modified by amino acid substitution to avoid binding of such domains to the transmembrane domains of the same or different surface membrane proteins to minimize interactions with other members of the receptor complex.

The transmembrane domain in some embodiments is derived either from a natural or from a synthetic source. Where the source is natural, the domain in some aspects is derived from any membrane-bound or transmembrane protein. Transmembrane regions include those derived from (i.e. comprise at least the transmembrane region(s) of) the alpha, beta or zeta chain of the T-cell receptor, CD28, CD3 epsilon, CD45, CD4, CD5, CD8, CD9, CD 16, CD22, CD33, CD37, CD64, CD80, CD86, CD134, CD137, CD154. Alternatively the transmembrane domain in some embodiments is synthetic. In some aspects, the synthetic transmembrane domain comprises predominantly hydrophobic residues such as leucine and valine. In some aspects, a triplet of phenylalanine, tryptophan and valine will be found at each end of a synthetic transmembrane domain. In some embodiments, the linkage is by linkers, spacers, and/or transmembrane domain(s).

Among the intracellular signaling domains are those that mimic or approximate a signal through a natural antigen receptor, a signal through such a receptor in combination with a costimulatory receptor, and/or a signal through a costimulatory receptor alone. In some embodiments, a short oligo- or polypeptide linker, for example, a linker of between 2 and 10 amino acids in length, such as one containing glycines and serines, e.g., glycine-serine doublet, is present and forms a linkage between the transmembrane domain and the cytoplasmic signaling domain of the CAR.

The CAR generally includes at least one intracellular signaling component or components. In some embodiments, the CAR includes an intracellular component of the TCR complex, such as a TCR CD3$^+$ chain that mediates T-cell activation and cytotoxicity, e.g., CD3 zeta chain. Thus, in some aspects, the antigen binding molecule is linked to one or more cell signaling modules. In some embodiments, cell signaling modules include CD3 transmembrane domain, CD3 intracellular signaling domains, and/or other CD transmembrane domains. In some embodiments, the CAR further includes a portion of one or more additional molecules such as Fc receptor γ, CD8, CD4, CD25, or CD16. For example, in some aspects, the CAR includes a chimeric molecule between CD3-zeta (CD3-0 or Fc receptor γ and CD8, CD4, CD25 or CD16.

In some embodiments, upon ligation of the CAR, the cytoplasmic domain or intracellular signaling domain of the CAR activates at least one of the normal effector functions or responses of the immune cell, e.g., T cell engineered to express the CAR. For example, in some contexts, the CAR induces a function of a T cell such as cytolytic activity or T-helper activity, such as secretion of cytokines or other factors. In some embodiments, a truncated portion of an intracellular signaling domain of an antigen receptor component or costimulatory molecule is used in place of an intact immunostimulatory chain, for example, if it transduces the effector function signal. In some embodiments, the intracellular signaling domain or domains include the cytoplasmic sequences of the T cell receptor (TCR), and in some aspects also those of the co-receptors that in the natural context act in concert with such receptor to initiate signal transduction following antigen receptor engagement, and/or any derivative or variant of such molecules, and/or any synthetic sequence that has the same functional capability.

In the context of a natural TCR, full activation generally requires not only signaling through the TCR, but also a costimulatory signal. Thus, in some embodiments, to promote full activation, a component for generating secondary or co-stimulatory signal is also included in the CAR. In other embodiments, the CAR does not include a component for generating a costimulatory signal. In some aspects, an additional CAR is expressed in the same cell and provides the component for generating the secondary or costimulatory signal. In some aspects, the cell comprises a first CAR which contains signaling domains to induce the primary signal and a second CAR which binds to a second antigen and contains the component for generating a costimulatory signal. For example, a first CAR can be an activating CAR and the second CAR can be a costimulatory CAR. In some aspects, both CARs must be ligated in order to induce a particular effector function in the cell, which can provide specificity and selectivity for the cell type being targeted.

T cell activation is in some aspects described as being mediated by two classes of cytoplasmic signaling sequences: those that initiate antigen-dependent primary activation through the TCR (primary cytoplasmic signaling sequences), and those that act in an antigen-independent manner to provide a secondary or co-stimulatory signal (secondary cytoplasmic signaling sequences). In some aspects, the CAR includes one or both of such signaling components.

In some aspects, the CAR includes a primary cytoplasmic signaling sequence that regulates primary activation of the TCR complex. Primary cytoplasmic signaling sequences that act in a stimulatory manner may contain signaling motifs which are known as immunoreceptor tyrosine-based activation motifs or ITAMs. Examples of ITAM containing primary cytoplasmic signaling sequences include those derived from TCR or CD3 zeta, FcR gamma, CD3 gamma, CD3 delta or CD3 epsilon. In some embodiments, cytoplasmic signaling molecule(s) in the CAR contain(s) a cytoplasmic signaling domain, portion thereof, or sequence derived from CD3 zeta.

In some embodiments, the CAR includes a signaling domain and/or transmembrane portion of a costimulatory receptor, such as CD28, 4-1BB, OX40, DAP10, and ICOS. In some aspects, the same CAR includes both the activating and costimulatory components; in other aspects, the activating domain is provided by one CAR whereas the costimulatory component is provided by another CAR recognizing another antigen.

In some embodiments, the activating domain is included within one CAR, whereas the costimulatory component is provided by another chimeric receptor recognizing another antigen. In some embodiments, the CARs include activating or stimulatory CARs, and costimulatory receptors, both expressed on the same cell (see WO2014/055668). In some aspects, the HPV 16 E6 or E7 antibody-containing receptor is the stimulatory or activating CAR; in other aspects, it is the costimulatory receptor. In some embodiments, the cells further include inhibitory CARs (iCARs, see Fedorov et al., *Sci. Transl. Medicine*, 5(215) (December, 2013), such as an inhibitory receptor recognizing a peptide epitope other than HPV 16 E6 or HPV16 E7, whereby an activating signal delivered through the HPV 16-targeting CAR is diminished or inhibited by binding of the inhibitory CAR to its ligand, e.g., to reduce off-target effects.

In some embodiments, the cell expressing the provided TCR or other binding molecule further expresses an additional receptor, such as a receptor capable of delivering a costimulatory or survival-promoting signal, such as a costimulatory receptor (see WO2014/055668) and/or to block or change the outcome of an inhibitory signal, such as one typically delivered via an immune checkpoint or other immunoinhibitory molecule, such as one expressed in the tumor microenvironment, e.g., in order to promote increased efficacy of such engineered cells. See, e.g., Tang et al., Am J Transl Res. 2015; 7(3): 460-473. In some embodiments, the cell may further include one or more other exogenous or recombinant or engineered components, such as one or more exogenous factors and/or costimulatory ligands, which are expressed on or in or secreted by the cells and can promote function, e.g., in the microenviroment. Exemplary of such ligands and components include, e.g., TNFR and/or Ig family receptors or ligands, e.g., 41BBL, CD40, CD40L, CD80, CD86, cytokines, chemokines, and/or antibodies or other molecules, such as scFvs. See, e.g., patent application publication Nos WO2008121420 A1, WO2014134165 A1, US20140219975 A1. In some embodiments, the cells comprise one or more inhibitory receptor ((iCARs, see Fedorov et al., *Sci. Transl. Medicine*, 5(215) (December, 2013)), such as one that binds to a ligand or antigen not associated with the disease or condition or not expressed therein or thereon.

In certain embodiments, the intracellular signaling domain comprises a CD28 transmembrane and signaling domain linked to a CD3 (e.g., CD3-zeta) intracellular domain. In some embodiments, the intracellular signaling domain comprises a chimeric CD28 and CD137 (4-1BB, TNFRSF9) co-stimulatory domains, linked to a CD3 zeta intracellular domain.

In some embodiments, the CAR encompasses one or more, e.g., two or more, costimulatory domains and an activation domain, e.g., primary activation domain, in the cytoplasmic portion. Exemplary CARs include intracellular components of CD3-zeta, CD28, and 4-1BB.

In some embodiments, the cell expressing the CAR or other antigen receptor further includes a marker, such as a cell surface marker, which may be used to confirm transduction or engineering of the cell to express the receptor, such as a truncated version of a cell surface receptor, such as truncated EGFR (tEGFR). In some aspects, the marker includes all or part (e.g., truncated form) of CD34, a NGFR, or epidermal growth factor receptor (e.g., tEGFR). In some embodiments, the nucleic acid encoding the marker is operably linked to a polynucleotide encoding for a linker sequence, such as a cleavable linker sequence, e.g., T2A. See WO2014031687. In some embodiments, introduction of a construct encoding the CAR and EGFRt separated by a T2A ribosome switch can express two proteins from the same construct, such that the EGFRt can be used as a marker to detect cells expressing such construct. In some embodiments, a marker, and optionally a linker sequence, can be any as disclosed in published patent application No. WO2014031687. For example, the marker can be a truncated EGFR (tEGFR) that is, optionally, linked to a linker sequence, such as a T2A cleavable linker sequence. An exemplary polypeptide for a truncated EGFR (e.g. tEGFR) comprises the sequence of amino acids set forth in SEQ ID NO: 273 or 343 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 273 or 343. An exemplary T2A linker sequence comprises the sequence of amino acids set forth in SEQ ID NO: 211 or 274 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 211 or 274.

In some embodiments, the marker is a molecule, e.g., cell surface protein, not naturally found on T cells or not naturally found on the surface of T cells, or a portion thereof.

In some embodiments, the molecule is a non-self molecule, e.g., non-self protein, i.e., one that is not recognized as "self" by the immune system of the host into which the cells will be adoptively transferred.

In some embodiments, the marker serves no therapeutic function and/or produces no effect other than to be used as a marker for genetic engineering, e.g., for selecting cells successfully engineered. In other embodiments, the marker may be a therapeutic molecule or molecule otherwise exerting some desired effect, such as a ligand for a cell to be encountered in vivo, such as a costimulatory or immune checkpoint molecule to enhance and/or dampen responses of the cells upon adoptive transfer and encounter with ligand.

In some cases, CARs are referred to as first, second, and/or third generation CARs. In some aspects, a first generation CAR is one that solely provides a CD3-chain induced signal upon antigen binding; in some aspects, a second-generation CARs is one that provides such a signal and costimulatory signal, such as one including an intracellular signaling domain from a costimulatory receptor such as CD28 or CD137; in some aspects, a third generation CAR in some aspects is one that includes multiple costimulatory domains of different costimulatory receptors.

In some embodiments, the chimeric antigen receptor includes an extracellular portion containing a TCR-like antibody or fragment described herein and an intracellular signaling domain. In some embodiments, the antibody or fragment includes a scFv and the intracellular domain contains an ITAM. In some aspects, the intracellular signaling domain includes a signaling domain of a zeta chain of a CD3-zeta (CD3) chain. In some embodiments, the chimeric antigen receptor includes a transmembrane domain linking the extracellular domain and the intracellular signaling domain. In some aspects, the transmembrane domain contains a transmembrane portion of CD28. The extracellular domain and transmembrane can be linked directly or indirectly. In some embodiments, the extracellular domain and transmembrane are linked by a spacer, such as any described herein. In some embodiments, the chimeric antigen receptor contains an intracellular domain of a T cell costimulatory molecule, such as between the transmembrane domain and intracellular signaling domain. In some aspects, the T cell costimulatory molecule is CD28 or 41BB.

For example, in some embodiments, the CAR contains a TCR-like antibody, e.g., an antibody fragment, as provided herein, a transmembrane domain that is or contains a transmembrane portion of CD28 or a functional variant thereof, and an intracellular signaling domain containing a signaling portion of CD28 or functional variant thereof and a signaling portion of CD3 zeta or functional variant thereof. In some embodiments, the CAR contains a TCR-like antibody, e.g., antibody fragment, as provided herein, a transmembrane domain that is or contains a transmembrane portion of CD28 or a functional variant thereof, and an intracellular signaling domain containing a signaling portion of a 4-1BB or functional variant thereof and a signaling portion of CD3 zeta or functional variant thereof. In some such embodiments, the CAR further includes a spacer containing a portion of an Ig molecule, such as a human Ig molecule, such as an Ig hinge, e.g. an IgG4 hinge, such as a hinge-only spacer.

In some embodiments, the transmembrane domain of the receptor, e.g., the TCR-like CAR, is a transmembrane domain of human CD28 (e.g., Accession No. P01747.1) or variant thereof, such as a transmembrane domain that comprises the sequence of amino acids set forth in SEQ ID NO: 275 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 275. In some embodiments, the transmembrane-domain containing portion of the CAR comprises the sequence of amino acids set forth in SEQ ID NO: 276 or a sequence of amino acids having at least at or about 85%, 86%, 87%, 88%, 89%, 90%, 91%, 92%, 93%, 94%, 95%, 96%, 97%, 98%, 99% or more sequence identity to SEQ ID NO: 276.

In some embodiments, the intracellular signaling component(s) of the CAR, e.g., the TCR-like CAR, contains an intracellular costimulatory signaling domain of human CD28 or a functional variant or portion thereof, such as a domain with an LL to GG substitution at positions 186-187 of a native CD28 protein. For example, the intracellular signaling domain can comprise the sequence of amino acids set forth in SEQ ID NO: 277 or 278 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 277 or 278. In some embodiments, the intracellular domain comprises an intracellular costimulatory signaling domain of 4-1BB (e.g. (Accession No. Q07011.1) or functional variant or portion thereof, such as the sequence of amino acids set forth in SEQ ID NO: 279 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 279.

In some embodiments, the intracellular signaling domain of the CAR, e.g. the TCR-like CAR, comprises a human CD3 zeta stimulatory signaling domain or functional variant thereof, such as an 112 AA cytoplasmic domain of isoform 3 of human CD3 (Accession No.: P20963.2) or a CD3 zeta signaling domain as described in U.S. Pat. No. 7,446,190 or U.S. Pat. No. 8,911,993. For example, in some embodiments, the intracellular signaling domain comprises the sequence of amino acids of SEQ ID NO: 280, 281, or 282, or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 280, 281, or 282.

In some aspects, the spacer contains only a hinge region of an IgG, such as only a hinge of IgG4 or IgG1, such as the hinge only spacer set forth in SEQ ID NO: 268. In other embodiments, the spacer is or contains an Ig hinge, e.g., an IgG4-derived hinge, optionally linked to a CH2 and/or CH3 domains. In some embodiments, the spacer is an Ig hinge, e.g., an IgG4 hinge, linked to CH2 and CH3 domains, such as set forth in SEQ ID NO: 271. In some embodiments, the spacer is an Ig hinge, e.g., an IgG4 hinge, linked to a CH3 domain only, such as set forth in SEQ ID NO: 270. In some embodiments, the spacer is or comprises a glycine-serine rich sequence or other flexible linker such as known flexible linkers.

For example, in some embodiments, the TCR-like CAR includes a TCR-like antibody or fragment, such as any provided herein, including scFvs, a spacer such as any of the Ig-hinge containing spacers, a CD28 transmembrane domain, a CD28 intracellular signaling domain, and a CD3 zeta signaling domain. In some embodiments, the TCR-like CAR includes the a TCR-like antibody or fragment, such as any provided herein, including scFvs, a spacer such as any of the Ig-hinge containing spacers, a CD28 transmembrane domain, a CD28 intracellular signaling domain, and a CD3 zeta signaling domain. In some embodiments, such TCR-like CAR constructs further includes a T2A ribosomal skip element and/or a tEGFR sequence, e.g., downstream of the CAR.

In some embodiments, such CAR constructs further includes a T2A ribosomal skip element and/or a tEGFR sequence, e.g., downstream of the CAR, such as set forth in SEQ ID NO: 211 or 274 and a tEGFR sequence set forth in SEQ ID NO: 273 or 343, or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 211, 273, 343, or 274.

In some embodiments, the CAR includes an HPV 16 E6 or E7 antibody or fragment, such as any of the HPV16 E6 or E7 antibodies, including sdAbs (e.g. containing only the $V_H$ region) and scFvs, described herein, a spacer such as any of the Ig-hinge containing spacers, a CD28 transmembrane domain, a CD28 intracellular signaling domain, and a CD3 zeta signaling domain. In some embodiments, the CAR includes the HPV 16 antibody or fragment, such as any of the HPV 16 E6 or E7 antibodies, including sdAbs and scFvs described herein, a spacer such as any of the Ig-hinge containing spacers, a CD28 transmembrane domain, a CD28 intracellular signaling domain, and a CD3 zeta signaling domain. In some embodiments, such CAR constructs further includes a T2A ribosomal skip element and/or a tEGFR sequence, e.g., downstream of the CAR.

3. Exemplary Features of Binding Molecules and Engineered Cells

In some aspects, the provided binding molecules, e.g. TCRs or TCR-like CAR have one or more specified functional features, such as binding properties, including binding to particular epitopes, lack of off-target binding or activity and/or particular binding affinities. In some embodiments, any one or more of the features of a provided TCR can be assessed by expressing the TCR, e.g., by introducing one or more nucleic acid encoding the TCR, into a T cell, such a primary T cell or a T cell line. In some embodiments, the T cell line is a Jurkat cell or a Jurkat-derived cell line. Exemplary of a Jurkat-derived cell line is the J.RT3-T3.5 (ATCC® TIB-153™) cell line, produced by treatment of the Jurkat leukemia cell line with irradiation mutagenesis and negative selection with OKT3 monoclonal antibody (see Weiss & Stobo, J. Ex. Med. 160(5):1284-1299 (1984)).

In some embodiments, the provided binding molecules are capable of binding to a peptide epitope of HPV16, e.g. an epitope of HPV 16 E6 or E7 such as described above, with at least a certain affinity, as measured by any of a number of known methods. In some embodiments, the peptide epitope is a peptide in the context of an MHC molecule or ligand. In some embodiments, the affinity is represented by an equilibrium dissociation constant ($K_D$) or an association constant ($k_a$). In some embodiments, the affinity is represented by $EC_{50}$.

In some embodiments, the binding molecule, e.g., TCR, binds, such as specifically binds, to a peptide epitope, e.g., in complex with an MHC molecule, with an affinity or $K_A$ (i.e., an equilibrium association constant of a particular binding interaction with units of 1/M; equal to the ratio of the on-rate [$k_{on}$ or $k_a$] to the off-rate [$k_{off}$ or $k_d$] for this association reaction, assuming bimolecular interaction) equal to or greater than $10^5$ M$^{-1}$. In some embodiments, the TCR or fragment thereof exhibits a binding affinity for the peptide epitope with a $K_D$ (i.e., an equilibrium dissociation constant of a particular binding interaction with units of M; equal to the ratio of the off-rate [$k_{off}$ or $k_d$] to the on-rate [$k_{on}$ or $k_a$] for this association reaction, assuming bimolecular interaction) of equal to or less than $10^{-5}$ M. For example, the equilibrium dissociation constant $K_D$ ranges from or from about $10^{-5}$ M to or to about $10^{-12}$ M, such as from from about $10^{-6}$ M to or to about $10^{10}$ M, from or from about $10^{-7}$ M to or to about $10^{-11}$ M, from or from about $10^{-6}$ M to or to about $10^{-8}$ M, or from or from about $10^{-7}$ M to or to about $10^{-8}$ M. The on-rate (association rate constant; $k_{on}$ or $k_a$; units of 1/Ms) and the off-rate (dissociation rate constant; $k_{off}$ or $k_d$; units of 1/s) can be determined using any of the assay methods known in the art, for example, surface plasmon resonance (SPR).

In some embodiments, binding affinity may be classified as high affinity or as low affinity. In some cases, the binding molecule (e.g. TCR) that exhibits low to moderate affinity binding exhibits a $K_A$ of up to $10^7$ M$^{-1}$, up to $10^6$ M$^{-1}$, up to $10^5$ M. In some cases, a binding molecule (e.g. TCR) that exhibits high affinity binding to a particular epitope interacts with such epitope with a $K_A$ of at least $10^7$ M$^{-1}$, at least $10^8$ M$^{-1}$, at least $10^9$ M$^{-1}$, at least $10^{10}$ M$^{-1}$, at least $10^{11}$ M$^{-1}$, at least $10^{12}$ M$^{-1}$, or at least $10^{13}$ M. In some embodiments, the binding affinity ($EC_{50}$) and/or the dissociation constant of the binding molecule to a peptide epitope of HPV 16 E6 or E7 is from or from about 0.1 nM to 1 µM, 1 nM to 1 µM, 1 nM to 500 nM, 1 nM to 100 nM, 1 nM to 50 nM, 1 nM to 10 nM, 10 nM to 500 nM, 10 nM to 100 nM, 10 nM to 50 nM, 50 nM to 500 nM, 50 nM to 100 nM or 100 nM to 500 nM. In certain embodiments, the binding affinity ($EC_{50}$) and/or the dissociation constant of the binding molecule to a peptide epitope of HPV 16 E6 or E7 is at or about or less than at or about 1 µM, 500 nm, 100 nM, 50 nM, 40 nM, 30 nM, 25 nM, 20 nM, 19 nM, 18 nM, 17 nM, 16 nM, 15 nM, 14 nM, 13 nM, 12 nM, 11 nM, 10 nM, 9 nM, 8 nM, 7 nM, 6 nM, 5 nM, 4 nM, 3 nM, 2 nM, or 1 nM.

A variety of assays are known for assessing binding affinity and/or determining whether a binding molecule specifically binds to a particular ligand (e.g. peptide in the context of an MHC molecule). It is within the level of a skilled artisan to determine the binding affinity of a binding molecule, e.g., TCR, for a T cell epitope of a target polypeptide, such as by using any of a number of binding assays that are well known in the art. For example, in some embodiments, a BIAcore machine can be used to determine the binding constant of a complex between two proteins. The dissociation constant for the complex can be determined by monitoring changes in the refractive index with respect to time as buffer is passed over the chip. Other suitable assays for measuring the binding of one protein to another include, for example, immunoassays such as enzyme linked immunosorbent assays (ELISA) and radioimmunoassays (RIA), or determination of binding by monitoring the change in the spectroscopic or optical properties of the proteins through fluorescence, UV absorption, circular dichroism, or nuclear magnetic resonance (NMR). Other exemplary assays include, but are not limited to, Western blot, ELISA, analytical ultracentrifugation, spectroscopy and surface plasmon resonance (Biacore®) analysis (see, e.g., Scatchard et al., Ann. N.Y. Acad. Sci. 51:660, 1949; Wilson, Science 295:2103, 2002; Wolff et al., Cancer Res. 53:2560, 1993; and U.S. Pat. Nos. 5,283,173, 5,468,614, or the equivalent), flow cytometry, sequencing and other methods for detection of expressed nucleic acids. In one example, apparent affinity for a TCR is measured by assessing binding to various concentrations of tetramers, for example, by flow cytometry using labeled tetramers. In one example, apparent $K_D$ of a TCR is measured using 2-fold dilutions of labeled tetramers at a range of concentrations, followed by determination of binding curves by non-linear regression, apparent $K_D$ being determined as the concentration of ligand that yielded half-maximal binding.

In some embodiments, the binding molecules display a binding preference for antigen recognition of HPV 16 E6- or E7-expressing cells as compared to HPV 16 E6- or E7-negative cells, such as particular cells known and/or described herein to express HPV 16 E6 or E7 and known not to express HPV 16 E6 or E7. In some embodiments, the binding preference is observed where a significantly greater degree of binding is measured to the HPV 16 E6- or E7-expressing, as compared to the non-HPV 16 E6- or E7-expressing cells. In some embodiments, the fold change in degree of binding detected, for example, as measured by mean fluorescence intensity in a flow cytometry-based assay and/or dissociation constant or $EC_{50}$, to the HPV 16 E6- or E7-expressing cells as compared to the non-HPV 16 E6- or E7-expressing cells, is at least at or about 1.5, 2, 3, 4, 5, 6, or more.

In some embodiments, the binding molecule, e.g. TCR, does not exhibit cross-reactive or off-target binding, such as undesirable off-target binding, e.g. off-target binding to antigens present in healthy or normal tissues or cells. In some embodiments, the binding molecule, e.g. TCR, recognizes, such as specifically binds, only one peptide epitope or antigen complex, such as recognizes only a particular HPV 16 E6 or E7 epitope set forth in any of SEQ ID NOs: 232-239 or an antigen complex thereof. Thus, in some embodiments, the provided binding molecules, e.g. TCRs, have a reduced risk of causing unwanted side effects due to, for example, recognition of a non-target peptide epitope.

In some embodiments, the binding molecule, e.g., TCR, does not recognize, such as does not specifically bind, a sequence-related peptide epitope of the HPV 16 E6 or E7 epitope set forth in any of SEQ ID NOS: 232-239, i.e., does not recognize an epitope sharing some amino acids in common with an HPV 16 E6 or E7 epitope set forth in any of SEQ ID NOS: 232-239, such as does not recognize an epitope that differs in 1, 2, 3, 4, 5 or 6 amino acid residues from such epitope when the epitopes are aligned. In some embodiments, the binding molecule, e.g., TCR, does not recognize a sequence-unrelated epitope of the HPV 16 E6 or E7 epitope set forth in any of SEQ ID NOS: 232-239, i.e., does not recognize an epitope that is substantially different in sequence compared to an HPC 16 E6 or E7 epitope set forth in any of SEQ ID NOS: 232-239, such as differing in more than 6, 7, 8, 9, 10 or more amino acid residues from such epitope when the epitopes are aligned. In some embodiments, the binding molecule, e.g., TCR, does not recognize the HPV 16 E6 or E7 epitope set forth in any of SEQ ID NOS: 232-239 in the context of a different MHC allele, such as in the context of an MHC allele other than HLA-A2.

Typically, specific binding of binding molecule, e.g. TCR, to a peptide epitope, e.g. in complex with an MHC, is governed by the presence of an antigen-binding site containing one or more complementarity determining regions (CDRs). In general, it is understood that specifically binds does not mean that the particular peptide epitope, e.g. in complex with an MHC, is the only thing to which the MHC-peptide molecule may bind, since non-specific binding interactions with other molecules may also occur. In some embodiments, binding of binding molecule to a peptide in the context of an MHC molecule is with a higher affinity than binding to such other molecules, e.g. another peptide in the context of an MHC molecule or an irrelevant (control) peptide in the context of an MHC molecule, such as at least about 2-fold, at least about 10-fold, at least about 20-fold, at least about 50-fold, or at least about 100-fold higher than binding affinity to such other molecules.

In some embodiments, the binding molecule, e.g., TCR, can be assessed for safety or off-target binding activity using any of a number of screening assays known in the art. In some embodiments, generation of an immune response to a particular binding molecule, e.g., TCR, can be measured in the presence of cells that are known not to express the target peptide epitope, such as cells derived from normal tissue(s), allogenic cell lines that express one or more different MHC types or other tissue or cell sources. In some embodiments, the cells or tissues include normal cells or tissues. For example, in some cases, cells or tissues can include brain, muscle, liver, colon, kidney, lung, ovary, placenta, heart, pancreas, prostate, epithelium or skin, testis, adrenal, intestine, bone marrow or spleen. In some embodiments, the binding to cells can be tested in 2 dimensional cultures. In some embodiments, the binding to cells can be tested in 3 dimensional cultures. In some embodiments, as a control, the tissues or cells can be ones that are known to express the target epitope. The immune response can be assessed directly or indirectly, such as by assessing activation of immune cells such as T cells (e.g. cytotoxic activity), production of cytokine (e.g. interferon gamma), or activation of a signaling cascade.

In some embodiments, potential off-targets can be identified by performing a homology scan of the human genome using the particular target epitope, e.g., to identify potential sequence-related epitopes. In some cases, a protein sequence database can be analyzed to identify peptides with similarity to the target peptide epitope. In some embodiments, to facilitate identification of potential sequence-related epitopes of interest, a binding motif can first be identified. In some embodiments, the binding motif can be identified by peptide scanning, such as an alanine mutagenesis scan, of the target epitope (e.g., HPV 16 E6 or E7 epitope set forth in any of SEQ ID NOS: 232-239) to identify the binding motif recognized by the binding molecule, see e.g. WO2014/096803. In some embodiments, the binding motif can be identified by mutagenesis of the target peptide so that a series of mutants are generated in which each amino acid or a subset thereof is changed to another amino acid residue, tested for its activity relative to the original target epitope, and those residues that are involved in or required for binding are identified. In some embodiments, a series of mutants may be made in which the amino acid residue at each position of the target epitope is mutated to all alternative amino acids. In some cases, once the binding motif is identified (i.e. amino acid residues that are non-tolerated and are involved in or are required for binding), protein databases may be searched for proteins that contain the binding motif.

In some embodiments, suitable protein databases include but are not limited to UniProtKB/Swiss-Prot (http://www.uniprot.org/), Protein Information Resource (PI R) (http://pir.georgetown.edu/pirwww/index.shtml), and/or Reference Sequence (RefSeq) (www.ncbi.nlm.nih.gov/RefSeq). Searching for a peptide motif may be carried out using any one of a number of tools, which may be found on bioinformatics resource sites such as ExPASY (http://www.expasy.org/). For example, the search tool ScanProsite identifies user-defined motifs in all protein sequences in the UniProtKB/Swiss-Prot Protein Knowledgebase (De Castro et al. Nucleic Acids Res. 2006 Jul. 1; 34 (Web Server issue):W362-5). In some cases, the search may be carried out for peptides that are of human origin or of organisms which are commonly present in humans, such as viral or bacterial pathogens, or commensal bacteria.

In some embodiments, if a potential off-target epitope is identified, the binding molecule, e.g., TCR, can be redesigned so that there is no longer any cross reactivity to the off target peptide(s), while maintaining binding, preferably with high affinity, to the target peptide epitope. For example, T cell receptors can be redesigned by mutagenesis using the methods described in WO 03/020763.

In some embodiments, the binding molecules, e.g., engineered cells comprising the binding molecules, e.g., TCRs, elicit an immune response to HPV 16. In some embodiments, cytotoxic T lymphocytes (CTL) may be activated when cells containing the binding molecules, e.g., TCRs, are contacted with target cells, such as those that express HPV 16, such as HPV 16 E6 or HPV 16 E7. For example, cells containing the TCRs may induce lysis of target cells, such as HPV 16-expressing, e.g., HPV 16 E6- or E7-expressing cells. In some aspects, the ability of the binding molecules, such as cells expressing the binding molecules, e.g., TCRs or CARs, to elicit an immune response can be determined by measuring cytokine release. In some embodiments, in response to coculture with or exposure to cells expressing the binding molecules, e.g., TCRs or CARs, a variety of cytokines are released when the cells are stimulated by an appropriate target cell known to express HPV 16, such as HPV 16 E6 or HPV 16 E7. Non-limiting examples of such cytokines include IFN-γ, TNF-α, and GM-CSF. Exemplary cells known to express HPV 16 include, but are not limited to, CaSki cells (ATCC No. CRL-1550, which contain about 600 copies of integrated HPV16) or other tumor cell expressing the relevant MHC molecule and the corresponding peptide epitope, e.g., HPV 16 E6 or E7 epitope, such as any of those set forth in SEQ ID NOs: 232-239.

In some embodiments, CTL activation can be determined. A variety of techniques exist for assaying the activity of CTL. In some embodiments, CTL activity can be assessed by assaying the culture for the presence of CTLs that lyse radio-labeled target cells, such as specific peptide-pulsed targets. These techniques include the labeling of target cells with radionuclides such as $Na_2$, $^{51}CrO_4$ or $^3H$-thymidine, and measuring the release or retention of the radionuclides from the target cells as an index of cell death. In some embodiments, CTL are known to release a variety of cytokines when they are stimulated by an appropriate target cell, such as a tumor cell expressing the relevant MHC molecule and the corresponding peptide epitope, and the presence of such epitope-specific CTLs can be determined by measuring cytokine release. Non-limiting examples of such cytokines include IFN-γ, TNF-α, and GM-CSF. Assays for these cytokines are well known in the art, and their selection is left to the skilled artisan. Methodology for measuring both target cell death and cytokine release as a measure of CTL reactivity are given in Coligan, J. E. et al. (Current Protocols in Immunology, 1999, John Wiley & Sons, Inc., New York).

In some embodiments, cytokine production can be measured as an indicator of an immune response. In some cases, such measured cytokines can include, without limitation, interlekukin-2 (IL-2), interferon-gamma (IFNγ), interleukin-4 (IL-4), TNF-alpha, interleukin-6 (IL-6), interleukin-10 (IL-10), interleukin-12 (IL-12) or TGF-beta. Assays to measure cytokines are well known in the art, and include, without limitation, ELISA, intracellular cytokine staining, cytometric bead array, RT-PCR, ELISPOT, flow cytometry and bio-assays in which cells responsive to the relevant cytokine are tested for responsiveness (e.g. proliferation) in the presence of a test sample.

In some embodiments, cells exposed to the binding molecules, e.g. cells containing the binding molecules, such as TCRs or CARs, are assessed for an immunological readout, such as using a T cell assay. In some embodiments, the binding molecule-containing cells can activate a CD8+ T cell response. In one embodiment, CD8+ T cell responses can be assessed by monitoring CTL reactivity using assays that include, but are not limited to, target cell lysis via $^{51}Cr$ release or detection of interferon gamma release, such as by enzyme-linked immunosorbent spot assay (ELISA), intracellular cytokine staining or ELISPOT. In some embodiments, the binding molecules, e.g., cells containing the binding molecules, such as TCRs or CARs, can activate a CD4+ T cell response. In some aspects, CD4+ T cell responses can be assessed by assays that measure proliferation, such as by incorporation of [3H]-thymidine into cellular DNA and/or by the production of cytokines, such as by ELISA, intracellular cytokine staining or ELISPOT. In some cases, the cytokine can include, for example, interleukin-2 (IL-2), interferon-gamma (IFN-gamma), interleukin-4 (IL-4), TNF-alpha, interleukin-6 (IL-6), interleukin-10 (IL-10), interleukin-12 (IL-12) or TGF beta. In some embodiments, recognition or binding of the peptide epitope, such as a MHC class II epitope, by the binding molecule can elicit or activate a CD4+ T cell response and/or a CD8+ T cell response.

In some embodiments, the binding specificity and/or function (e.g., ability to elicit an immune response to HPV 16) of the binding molecule, e.g., TCR or antigen-binding fragment thereof, is at least partially CD8-independent. In some cases, TCR recognition of a peptide in the context of an MHC molecule and subsequent T cell activation is facilitated in the presence of a CD8 co-receptor. For example, CD8 coreceptor engagement can facilitate low- to moderate-TCR affinity interactions and/or T cell activation (See, for example, Kerry et al. J. Immunology (2003) 171(9): 4493-4503 and Robbins et al. J Immunology (2008) 180(9): 6116-6131). Among the provided binding molecules are molecules, e.g. TCRs, that exhibit CD8-independent binding for an HPV E6 or E7 peptide epitope. In some embodiments, such binding molecules, e.g. TCR, may have higher functional avidity or affinity than TCRs or antigen binding fragments thereof that require the presence of CD8 co-expression. In some aspects, the provided CD8-independent binding molecules, such as TCRs, can be expressed or engineered in cells, e.g. T cells, that do not express CD8, such as can be expressed or engineered in CD4+ cells. In some embodiments, among the provided engineered non-CD8-expressing cells, e.g. CD4+ cells, are cells expressing a recombinant binding molecule, e.g., TCR or antigen-binding fragment, that exhibit at least or at least about 20%, 30%, 40%, 50%, 60%, 70%, 80%, 90% or more of the binding specificity, affinity and/or avidity for a peptide in the context of an MHC molecule as the same binding molecule (e.g., TCR or antigen-binding fragment thereof) that is expressed on a CD8+ T cell.

II. Nucleic Acids, Vectors and Methods of Expression

Also provided are nucleic acids encoding any of the provided binding molecules, e.g., TCRs or antigen-binding fragments thereof or antibodies or antigen-binding fragments thereof or CARs containing such antibodies, such as those described herein. The nucleic acids may include those encompassing natural and/or non-naturally occurring nucleotides and bases, e.g., including those with backbone modifications. The terms "nucleic acid molecule," "nucleic acid," and "polynucleotide" may be used interchangeably, and refer to a polymer of nucleotides. Such polymers of nucleotides may contain natural and/or non-natural nucleotides, and include, but are not limited to, DNA, RNA, and PNA. "Nucleic acid sequence" refers to the linear sequence of nucleotides that comprise the nucleic acid molecule or polynucleotide.

In some embodiments, the binding molecule, e.g. TCR, or antigen binding portion thereof may be a recombinantly produced natural protein or mutated form thereof in which one or more property, such as binding characteristic, has been altered. In some aspects, the nucleic acid is synthetic. In some cases, the nucleic acid is or contains cDNA. In some aspects, the nucleic acid molecule can be modified for use in the constructs described herein, such as for codon optimization. In some cases, the sequences can be designed to contain terminal restriction site sequences for purposes of cloning into vectors.

In some embodiments, nucleic acid molecule encoding the binding molecule, e.g. TCR, can be obtained from a variety of sources, such as by polymerase chain reaction (PCR) amplification of encoding nucleic acids within or isolated from a given cell or cells. In some embodiments, the TCR is obtained from a biological source, such as from cells such as from a T cell (e.g. cytotoxic T cell), T cell hybridomas or other publicly available source. In some embodiments, a TCR may be derived from one of various animal species, such as human, mouse, rat, or other mammal, such as generally from a human. In some embodiments, the T cells can be obtained from in vivo isolated cells, such as from normal (or healthy) subjects or diseased subjects, including T cells present in peripheral blood mononuclear cells (PBMCs) or tumor-infiltrating lymphocytes (TILs). In some embodiments, the T cells can be a cultured T cell hybridoma or clone. For example, in some embodiments, to generate a vector encoding a TCR, the α and β chains can be PCR amplified from total cDNA isolated from a T cell clone expressing the TCR of interest and cloned into an expression vector. In some embodiments, the α and β chains can be synthetically generated. In some embodiments, the α and β chains are cloned into the same vector.

In some embodiments, the TCR or antigen-binding portion thereof can be synthetically generated from knowledge of the sequence of the TCR.

In some embodiments, the nucleic acid molecule contains a nucleic acid sequence encoding an alpha chain and/or a nucleotide sequence encoding a beta chain.

In some embodiments, the nucleic acid sequence encoding the alpha chain comprises one of the following: residues 61-816 of SEQ ID NO: 20, residues 58-804 of SEQ ID NO: 30, residues 61-825 of SEQ ID NO: 40, residues 64-813 of SEQ ID NO: 50, residues 64-816 of SEQ ID NO: 60, residues 58-807 of SEQ ID NO: 70, residues 61-825 of SEQ ID NO: 80, residues 67-831 of SEQ ID NO: 90, residues 58-801 of SEQ ID NO: 100, residues 64-810 of SEQ ID NO: 183, residues 58-801 of SEQ ID NO: 202, residues 67-813 of SEQ ID NO: 219, a degenerate sequence thereof or a sequence having at least 90%, 91%, 92%, 93%, 94%, 95%, 96%, 97%, 98%, 99% or more sequence identity thereto. In some aspects, the nucleotide sequence encoding the beta chain comprises one of the following: residues 58-936 of SEQ ID NO: 17, residues 58-930 of SEQ ID NO: 16, residues 58-939 of SEQ ID NO: 24, residues 64-930 of SEQ ID NO: 34 or 44, residues 58-933 of SEQ ID NO: 55, residues 58-927 of SEQ ID NO: 64, residues 64-936 of SEQ ID NO: 74, residues 58-933 of SEQ ID NO: 84, residues 63-930 of SEQ ID NO: 94, residues 46-936 of SEQ ID NO: 104, residues 58-933 of SEQ ID NO: 108, a degenerate sequence thereof or a sequence having at least 90%, 91%, 92%, 93%, 94%, 95%, 96%, 97%, 98%, 99% or more sequence identity thereto.

In some embodiments, the nucleotide sequence encoding the alpha chain and/or the nucleotide sequence encoding the beta chain is codon-optimized. Typically, codon optimization involves balancing the percentages of codons selected with the published abundance of human transfer RNAs so that none is overloaded or limiting. This may be necessary in some cases because most amino acids are encoded by more than one codon, and codon usage varies from organism to organism. Differences in codon usage between transfected genes and host cells can have effects on protein expression and immunogenicity of a nucleic acid construct. In general, for codon optimization, codons are chosen to select for those codons that are in balance with human usage frequency. Typically, the redundancy of the codons for amino acids is such that different codons code for one amino acid. In some embodiments, in selecting a codon for replacement, it may be desired that the resulting mutation is a silent mutation such that the codon change does not affect the amino acid sequence. Generally, the last nucleotide of the codon can remain unchanged without affecting the amino acid sequence.

In some cases, the nucleic acid sequence encoding the alpha chain contains one of the following: residues 67-825 of SEQ ID NO: 10, residues 58-813 of SEQ ID NO: 11, residues 64-822 of SEQ ID NO: 12 residues 61-825 of SEQ ID NO: 21, residues 58-813 of SEQ ID NO: 31, residues 61-834 of SEQ ID NO: 41, residues 63-822 of SEQ ID NO: 51, residues 64-825 of SEQ ID NO: 61, residues 58-816 of SEQ ID NO: 71, residues 61-834 of SEQ ID NO: 81, residues 67-840 of SEQ ID NO: 91, residues 58-810 of SEQ ID NO: 101, a degenerate sequence thereof or a sequence having at least 90%, 91%, 92%, 93%, 94%, 95%, 96%, 97%, 98%, 99% or more sequence identity thereto. In some examples, the nucleotide sequence encoding the beta chain contains one of the following: residues 58-930 of SEQ ID NO: 7, residues 58-936 of SEQ ID NO: 8, residues 58-933 of SEQ ID NO: 9 residues 58-939 of SEQ ID NO: 25, residues 64-930 of SEQ ID NO: 35, 45, or 95, residues 58-933 of SEQ ID NO: 54 or 85, residues 58-927 of SEQ ID NO: 65, residues 64-936 of SEQ ID NO: 75, residues 46-936 of SEQ ID NO: 105, a degenerate sequence thereof or a sequence having at least 90%, 91%, 92%, 93%, 94%, 95%, 96%, 97%, 98%, 99% or more sequence identity thereto.

In some embodiments, the nucleic acid molecule encoding an alpha chain and/or beta chain of a TCR comprises a nucleic acid sequence corresponding to a SEQ ID NO. set forth in Table 11. Also among the provided nucleic acid molecules encoding a TCR are those containing sequences at least at or about 90, 91, 92, 93, 94, 95, 96, 97, 98, or 99% identical to such sequences. Exemplary TCRs encoded by such sequences, or their modified versions, also are set forth in the Table 11.

TABLE 11

HPV16 E6 & E7 TCR Nucleotide SEQ ID NOs.

| Exemplary TCR or modified version thereof | Alpha | | Beta | |
|---|---|---|---|---|
| | Native | Codon-Optimized | Native | Codon-Optimized |
| TCR 3 | 20 | 21 | 24 | 25 |
| TCR 4 | 30 | 31 | 34 | 35 |
| TCR 5 | 40 | 41 | 44 | 45 |
| TCR 8 | 70 | 71 | 74 | 75 |
| TCR 9 | 80 | 81 | 84 | 85 |
| TCR 10 | 90 | 91 | 94 | 95 |
| TCR 6 | 50 | 51 | 54 | 55 |
| TCR 7 | 60 | 61 | 64 | 65 |
| TCR 11 | 100 | 101 | 104 | 105 |
| TCR 12 | 183 | 12 | 108 | 9 |
| TCR 13 | 202 | 11 | 17 | 8 |
| TCR 14 | 219 | 10 | 16 | 7 |
| TCR 15 | 389 | 1097 | 390 | 1098 |
| TCR 16 | 430 | 1099 | 431 | 1100 |
| TCR 17 | 1019 | 1101 | 1020 | 1102 |
| TCR 18 | 1021 | 1103 | 1022 | 1104 |
| TCR 19 | 1023 | 1105 | 1024 | 1106 |
| TCR 20 | 1025 | 1107 | 1026 | 1108 |
| TCR 21 | 1027 | 1109 | 1028 | 1110 |
| TCR 22 | 1029 | 1111 | 1030 | 1112 |
| TCR 23 | 1031 | 1113 | 1032 | 1114 |
| TCR 24 | 1033 | 1115 | 1034 | 1116 |
| TCR 25 | 1035 | 1117 | 1036 | 1118 |
| TCR 26 | 1037 | 1119 | 1038 | 1120 |
| TCR 27 | 1039 | 1121 | 1040 | 1122 |
| TCR 28 | 1041 | 1123 | 1042 | 1124 |
| TCR 29 | 1043 | 1125 | 1044 | 1126 |
| TCR 30 | 1045 | 1127 | 1046 | 1128 |
| TCR 31 | 1225 | 1129 | 1224 | 1130 |
| TCR 32 | 1049 | 1131 | 1050 | 1132 |
| TCR 33 | 1051 | 1133 | 1052 | 1134 |
| TCR 34 | 1226 | 1135 | 1227 | 1136 |
| TCR 35 | 1055 | 1137 | 1056 | 1138 |
| TCR 36 | 1057 | 1139 | 1058 | 1140 |
| TCR 37 | 1059 | 1141 | 1060 | 1142 |
| TCR 38 | 1061 | 1143 | 1062 | 1144 |
| TCR 39 | 1063 | 1145 | 1064 | 1146 |
| TCR 40 | 1065 | 1147 | 1066 | 1148 |
| TCR 41 | 1067 | 1149 | 1068 | 1150 |
| TCR 42 | 1069 | 1151 | 1070 | 1152 |
| TCR 43 | 1071 | 1153 | 1072 | 1154 |
| TCR 44 | 1073 | 1155 | 1074 | 1156 |
| TCR 45 | 1075 | 1157 | 1076 | 1158 |
| TCR 46 | 1077 | 1159 | 1078 | 1160 |
| TCR 47 | 1079 | 1161 | 1080 | 1162 |
| TCR 48 | 1081 | 1163 | 1082 | 1164 |
| TCR 49 | 1083 | 1165 | 1084 | 1166 |
| TCR 50 | 1085 | 1167 | 1086 | 1168 |
| TCR 51 | 1087 | 1169 | 1088 | 1170 |
| TCR 52 | 1089 | 1171 | 1090 | 1172 |
| TCR 53 | 1091 | 1173 | 1092 | 1174 |
| TCR 54 | 1093 | 1175 | 1094 | 1176 |
| TCR 55 | 1095 | 1177 | 1228 | 1178 |

Also provided are vectors or constructs containing such nucleic acid molecules. In some embodiments, the vectors or constructs contain one or more promoters operatively linked to the nucleotide encoding the alpha chain and/or beta chain. In some embodiments, the promoter is operatively linked to one or more than one nucleic acid molecule.

In some embodiments, the vector or construct can contain a single promoter that drives the expression of one or more nucleic acid molecules. In some embodiments, such promoters can be multicistronic (bicistronic or tricistronic, see e.g., U.S. Pat. No. 6,060,273). For example, in some embodiments, transcription units can be engineered as a bicistronic unit containing an IRES (internal ribosome entry site), which allows coexpression of gene products (e.g. encoding an alpha chain and/or beta chain of a TCR) by a message from a single promoter. Alternatively, in some cases, a single promoter may direct expression of an RNA that contains, in a single open reading frame (ORF), two or three genes (e.g. encoding an alpha chain and/or beta chain of a TCR) separated from one another by sequences encoding a self-cleavage peptide (e.g., T2A) or a protease recognition site (e.g., furin). The ORF thus encodes a single polyprotein, which, either during (in the case of 2A e.g., T2A) or after translation, is cleaved into the individual proteins. In some cases, the peptide, such as T2A, can cause the ribosome to skip (ribosome skipping) synthesis of a peptide bond at the C-terminus of a 2A element, leading to separation between the end of the 2A sequence and the next peptide downstream (see, for example, de Felipe. *Genetic Vaccines and Ther.* 2:13 (2004) and deFelipe et al. *Traffic* 5:616-626 (2004)). Examples of 2A cleavage peptides, including those that can induce ribosome skipping, are Thosea asigna virus (T2A, e.g., SEQ ID NO: 211 or 274), porcine teschovirus-1 (P2A, e.g., SEQ ID NO: 204 or 345), equine rhinitis A virus (E2A, e.g., SEQ ID NO: 346) and 2A sequences from the foot-and-mouth disease virus (F2A, e.g., SEQ ID NO: 344) as described in U.S. Patent Publication No. 2007/0116690.

In some cases, the nucleotide sequence encoding the alpha chain and the nucleotide sequence encoding the beta chain are separated by a nucleotide sequence encoding an internal ribosome entry site (IRES) or a peptide sequence that causes ribosome skipping. In some instances, the nucleotide sequence encoding the alpha chain and the nucleotide sequence encoding the beta chain are separated by a peptide sequence that causes ribosome skipping. In some such instances, the peptide that causes ribosome skipping is a P2A or T2A peptide and/or contains the sequence of amino acids set forth in SEQ ID NO: 204, 211, 274 or 345. In some aspects, the nucleotide sequence encoding the peptide that causes ribosome skipping contains the sequence set forth in SEQ ID NO: 4, 5, 6, 207, 208, 209, or 210, 347, 1096, 1179, 1180, or 1181.

In some embodiments, the nucleic acid sequence encoding the alpha chain and the nucleotide sequence encoding the beta chain are present in any order, separated by the nucleotide sequence encoding an internal ribosome entry site (IRES) or a peptide sequence that causes ribosome skipping. For example, in some embodiments, the nucleic acid molecule comprises a nucleic acid sequence encoding a beta chain, a nucleic acid sequence encoding an IRES or peptide sequence that causes ribosome skipping, e.g., a P2A or T2A sequence as described herein, and a nucleic acid sequence that encodes an alpha chain, in that order. In other embodiments, the nucleic acid molecule contains a nucleic acid sequence that encodes an alpha chain, a nucleic acid sequence that encodes an IRES or peptide sequence that causes ribosome skipping, and a nucleic acid sequence that encodes a beta chain, in that order.

Thus, in some aspects, the nucleic acid molecule encodes a polypeptide comprising a beta chain, an IRES or peptide that causes ribosome skipping, and an alpha chain, in that order. In other aspects, the nucleic acid molecule encodes a polypeptide comprising an alpha chain, an IRES or peptide that causes ribosome skipping, and a beta chain, in that order.

In some embodiments, the nucleic acid molecule encodes a polypeptide containing an amino acid sequence set forth in Table 12, or a sequence having at least 90%, 91%, 92%, 93%, 94%, 95%, 96%, 97%, 98%, or 99% sequence identity thereto. In some embodiments, the nucleic acid molecule encodes a polypeptide set forth in any of SEQ ID NOS: 1, 2, 3, 27, 37, 47, 57, 67, 77, 87, 97, 107, 223, 224, 225, 226, 227, 228, 229, 230, 231, 340-342, 350-388, or 391-429, or a sequence having at least 90%, 91%, 92%, 93%, 94%, 95%, 96%, 97%, 98%, or 99% sequence identity thereto. In some embodiments, the nucleic acid molecule comprises the nucleic acid sequence set forth in any of SEQ ID NOs: 13, 14, 15, 26, 36, 46, 56, 66, 76, 86, 96, 106, 432-472, or a sequence having at least 90%, 91%, 92%, 93%, 94%, 95%, 96%, 97%, 98%, or 99% sequence identity thereto.

Also provided are polypeptides containing a sequence encoded by any of the provided nucleic acids. In some aspects, the polypeptide comprises an amino acid sequence corresponding to a SEQ ID NO. shown in Table 12, or a sequence having at least 90%, 91%, 92%, 93%, 94%, 95%, 96%, 97%, 98%, or 99% sequence identity thereto. In some embodiments, the polypeptide comprises the sequence set forth in any of SEQ ID NOS 1, 2, 3, 27, 37, 47, 57, 67, 77, 87, 97, 107, 223, 224, 225, 226, 227, 228, 229, 230, 231, 340-342, 350-388, or 391-429, or a sequence having at least 90%, 91%, 92%, 93%, 94%, 95%, 96%, 97%, 98%, or 99% sequence identity thereto. Exemplary of such TCRs, or their modified versions, also are set forth in the Table 12.

TABLE 12

HPV16 E6 & E7 TCR SEQ ID NOs.

| Exemplary TCR or modified version | Full Encoded Amino Acid | | Full Nucleotide Codon-Optimized |
|---|---|---|---|
| | Native | Modified | |
| TCR 3 | 223 | 27 | 26 |
| TCR 4 | 224 | 37 | 36 |
| TCR 5 | 225 | 47 | 46 |
| TCR 8 | 228 | 77 | 76 |
| TCR 9 | 229 | 87 | 86 |
| TCR 10 | 230 | 97 | 96 |
| TCR 6 | 226 | 57 | 56 |
| TCR 7 | 227 | 67 | 66 |
| TCR 11 | 231 | 107 | 106 |
| TCR 12 | 340 | 3 | 15 |
| TCR 13 | 341 | 2 | 14 |
| TCR 14 | 342 | 1 | 13 |
| TCR 15 | 391 | 350 | 432 |
| TCR 16 | 392 | 351 | 433 |
| TCR 17 | 393 | 352 | 434 |
| TCR 18 | 394 | 353 | 435 |
| TCR 19 | 395 | 354 | 436 |
| TCR 20 | 396 | 355 | 437 |
| TCR 21 | 397 | 356 | 438 |
| TCR 22 | 398 | 357 | 439 |
| TCR 23 | 399 | 358 | 440 |
| TCR 24 | 400 | 359 | 441 |
| TCR 25 | 401 | 360 | 442 |
| TCR 26 | 402 | 361 | 443 |
| TCR 27 | 403 | 362 | 444 |
| TCR 28 | 404 | 363 | 445 |
| TCR 29 | 405 | 364 | 446 |
| TCR 30 | 406 | 365 | 447 |
| TCR 31 | 407 | 366 | 448 |
| TCR 32 | 408 | 367 | 449 |
| TCR 33 | 409 | 368 | 450 |
| TCR 34 | 410 | 369 | 451 |
| TCR 35 | 411 | 370 | 452 |
| TCR 36 | 412 | 371 | 453 |
| TCR 37 | 413 | 372 | 454 |
| TCR 38 | 414 | 373 | 455 |
| TCR 39 | 415 | 374 | 456 |
| TCR 40 | 416 | 375 | 457 |
| TCR 41 | 417 | 376 | 458 |
| TCR 42 | 418 | 377 | 459 |
| TCR 43 | 419 | 378 | 460 |
| TCR 44 | 420 | 379 | 461 |
| TCR 45 | 421 | 380 | 462 |
| TCR 46 | 422 | 381 | 463 |
| TCR 47 | 423 | 382 | 464 |
| TCR 48 | 424 | 383 | 465 |
| TCR 49 | 425 | 384 | 466 |
| TCR 50 | 426 | 385 | 467 |
| TCR 51 | 427 | 386 | 468 |
| TCR 52 | 428 | 387 | 469 |
| TCR 53 | 429 | 388 | 470 |
| TCR 54 | 227 | 67 | 471 |
| TCR 55 | 340 | 3 | 472 |

In some embodiments, the nucleic acid molecule may further encode a marker (e.g. EGFRt or other marker as described) that is separated from the CAR or separated from the TCR chains by a linker, such as a cleavable linker sequence or a peptide sequence that causes ribosome skipping, e.g., T2A or P2A.

In some embodiments, the construct can be arranged in any order so that the encoding marker sequence is either 3' to the alpha and/or beta sequence, 5' to the alpha and/or beta sequence and/or between the alpha and beta sequence, where, in some cases, each separate component is separated by a cleavable linker sequence or a peptide that causes ribosome skipping (e.g. T2A or P2A) or an IRES. In some embodiments, the nucleic acid molecule contains a nucleic acid sequence that encodes a marker (e.g., EGFRt), cleavable linker or ribosome skip sequence (e.g. T2A or P2A), beta chain, cleavable linker or ribosome skip sequence (e.g. T2A or P2A), and alpha chain, in that order. In some embodiments, the nucleic acid molecule contains a nucleic acid sequence that encodes a marker (e.g., EGFRt), cleavable linker or ribosome skip sequence (e.g., T2A or P2A), alpha chain, cleavable linker or ribosome skip sequence (e.g., T2A or P2A), and beta chain, in that order. In some embodiments, the nucleic acid molecule contains a nucleic acid sequence that encodes a beta chain, cleavable linker or ribosome skip sequence (e.g., T2A or P2A), an alpha chain, a cleavable linker or ribosome skip sequence (e.g., T2A or P2A) and a marker (e.g. EGFRt), in that order. In some embodiments, the nucleic acid molecule contains a nucleic acid sequence that encodes a alpha chain, cleavable linker or ribosome skip sequence (e.g. T2A or P2A), a beta chain, a cleavable linker or ribosome skip sequence (e.g., T2A or P2A) and a marker (e.g., EGFRt), in that order. In some embodiments, the nucleic acid molecule contains a nucleic acid sequence that encodes a alpha chain, cleavable linker or ribosome skip sequence (e.g., T2A or P2A), a marker (e.g., EGFRt), a cleavable linker or ribosome skip sequence (e.g., T2A or P2A) and a beta chain, in that order. In some embodiments, the nucleic acid molecule contains a nucleic acid sequence that encodes a beta chain, cleavable linker or ribosome skip sequence (e.g., T2A or P2A), a marker (e.g. EGFRt), a cleavable linker or ribosome skip sequence (e.g., T2A or P2A) and a alpha chain, in that order.

In some embodiments, introduction of a construct encoding the CAR and EGFRt separated by a T2A ribosome switch can express two proteins from the same construct, such that the EGFRt can be used as a marker to detect cells expressing such construct.

The nucleic acid may encode an amino acid sequence comprising the variable alpha (Vα) region or variable light (VL) region of the TCR or antibody, respectively. In some cases, the nucleic acid encodes an amino acid sequence comprising the variable beta (Vβ) region or variable heavy (VH) region of the TCR or antibody, respectively. In a further embodiment, one or more vectors (e.g., expression vectors) comprising such nucleic acid are provided.

Also provided are vectors, such as those containing any of the nucleic acids described herein. In some embodiments, nucleic acid or nucleic acids encoding one or both chains of a binding molecule, e.g., TCR, are cloned into a suitable expression vector or vectors. The expression vector can be any suitable recombinant expression vector, and can be used to transform or transfect any suitable host. Suitable vectors include those designed for propagation and expansion or for expression or both, such as plasmids and viruses. In some embodiments, the vector is an expression vector.

In some embodiments, the vector can a vector of the pUC series (Fermentas Life Sciences), the pBluescript series (Stratagene, LaJolla, Calif.), the pET series (Novagen, Madison, Wis.), the pGEX series (Pharmacia Biotech, Uppsala, Sweden), or the pEX series (Clontech, Palo Alto, Calif.). In some cases, bacteriophage vectors, such as λG10, λGT11, λZapII (Stratagene), λEMBL4, and λNM1149, also can be used. In some embodiments, plant expression vectors can be used and include pBI01, pBI101.2, pBI101.3, pBI121 and pBIN19 (Clontech). In some embodiments, animal expression vectors include pEUK-Cl, pMAM and pMAM-neo (Clontech). In some cases, the vector is a viral vector. In some such aspects, the viral vector is a retroviral vector, such as a lentiviral vector. In some instances, the lentiviral vector is derived from HIV-1.

In some embodiments, the recombinant expression vectors can be prepared using standard recombinant DNA techniques. In some embodiments, vectors can contain regulatory sequences, such as transcription and translation initiation and termination codons, which are specific to the type of host (e.g., bacterium, fungus, plant, or animal) into which the vector is to be introduced, as appropriate and taking into consideration whether the vector is DNA- or RNA-based. In some embodiments, the vector can contain a nonnative promoter operably linked to the nucleotide sequence encoding the binding molecule, such as TCR, antibody or antigen-binding fragment thereof. In some embodiments, the promoter can be a non-viral promoter or a viral promoter, such as a cytomegalovirus (CMV) promoter, an SV40 promoter, an RSV promoter, and a promoter found in the long-terminal repeat of the murine stem cell virus. Other promoters known to a skilled artisan also are contemplated.

Also provided are methods of making the binding molecules (including antigen-binding fragments). In some embodiments, a host cell comprising such nucleic acid is provided. For recombinant production of the binding molecules, nucleic acid encoding the binding molecule, e.g., as described above, may be isolated and inserted into one or more vectors for further cloning and/or expression in a host cell. Such nucleic acid may be readily isolated and sequenced using conventional procedures (e.g., by using oligonucleotide probes that are capable of binding specifically to genes encoding the alpha and beta chains of the TCR or the heavy and light chains of the antibody). In some embodiments, a method of making the binding molecule is provided, wherein the method comprises culturing a host cell comprising a nucleic acid encoding the binding molecule, as provided above, under conditions suitable for expression of the binding molecule, and optionally recovering the binding molecule from the host cell (or host cell culture medium).

In one such embodiment, a host cell comprises (e.g., has been transformed with): a vector comprising a nucleic acid that encodes an amino acid sequence comprising the Vβ region of the TCR or antigen-binding fragment thereof and a nucleic acid that encodes an amino acid sequence comprising the Vα region of the TCR or antigen-binding fragment thereof. In another such embodiment, a host cell comprises (e.g. has been transformed with): a vector comprising a nucleic acid that encodes an amino acid sequence comprising the VH of the antibody or antigen-binding fragment thereof and the VL of the antibody or antigen-binding fragment thereof. In some aspects, a host cell comprises (e.g., has been transformed with): a first vector comprising a nucleic acid that encodes an amino acid sequence comprising the Vα region of the TCR or antigen-binding fragment thereof and a second vector comprising a nucleic acid that encodes an amino acid sequence comprising the Vβ region of the TCR or antigen-binding fragment thereof. In other aspects, a host cell comprises (e.g. has been transformed with): a first vector comprising a nucleic acid that encodes an amino acid sequence or comprising the VL of the antibody or antigen-binding fragment thereof and a second vector comprising a nucleic acid that encodes an amino acid sequence comprising the VH of the antibody or antigen-binding fragment thereof.

In addition to prokaryotes, eukaryotic microbes such as filamentous fungi or yeast are suitable cloning or expression hosts for binding molecule-encoding vectors, including fungi and yeast strains whose glycosylation pathways have been modified to mimic or approximate those in human cells. See Gerngross, Nat. Biotech. 22:1409-1414 (2004), and Li et al., Nat. Biotech. 24:210-215 (2006).

Exemplary eukaryotic cells that may be used to express polypeptides include, but are not limited to, COS cells, including COS 7 cells; 293 cells, including 293-6E cells; CHO cells, including CHO-S, DG44. Lec13 CHO cells, and FUT8 CHO cells; PER.C6® cells; and NSO cells. In some embodiments, a particular eukaryotic host cell is selected based on its ability to make desired post-translational modifications to the binding molecule. For example, in some embodiments, CHO cells produce polypeptides that have a higher level of sialylation than the same polypeptide produced in 293 cells. In some embodiments, the binding molecule is produced in a cell-free system. Exemplary cell-free systems are described, e.g., in Sitaraman et al., *Methods Mol. Biol.* 498: 229-44 (2009); Spirin, *Trends Biotechnol.* 22: 538-45 (2004); Endo et al., *Biotechnol. Adv.* 21: 695-713 (2003).

III. Methods for Identifying and Generating T Cell Receptors

In some embodiments, provided are methods for identifying and generating T cell receptors directed towards a target antigen. In some aspects, the methods involve subjecting biological samples containing T cells, such as primary T cells, including those derived from normal donors or patients having a disease or condition of interest, to multiple rounds of antigen exposure and assessment. In some aspects, the rounds involve the use of artificial or engineered antigen presenting cells, such as autologous dendritic cells or other APCs pulsed with a desired peptide antigen, to promote presentation on an MHC, such as a class I or II MHC. In some aspects, multiple rounds of antigen exposure are carried out and in some aspects T cells are sorted following one or more of the rounds, e.g., based on ability to bind to the desired antigen (such as peptide-MHC tetramers). In some aspects sorting is carried out by flow cytometry. In some aspects, cells from cells deemed to bind to the desired antigen (positive fraction) and cells deemed not to bind to the antigen, are assessed, e.g., by single-cell sequencing methods. In some aspects, the methods sequence and identify, at a single-cell level, TCR pairs present in each sample. In some aspects, the methods can quantify the number of copies of a given TCR pair present in a sample, and as such can assess the abundance of a given TCR in a given sample, and/or enrichment thereof over another sample, such as enrichment or abundance in the positive (antigen-binding) fraction, e.g., over one or more rounds, for example, as compared to the negative fraction. In some aspects, such assays are performed to generate antigen-specific T cell receptors (TCRs) that specifically bind to human papillomavirus 16 or 18 peptide antigens such as peptides derived from E6 or E7, such as E6(29-38) or E7(11-19) peptide, e.g., presented on MHC-I molecules and survived and/or were enriched over time, following multiple rounds of antigen-stimulation. In some aspects, clonal T cell lines are generated and the sequences of individual paired TCR alpha and beta chains and abundance thereof in various populations were determined on a single-cell basis, using high-throughput paired TCR sequencing.

In some aspects, peptide-pulsed HLA:A02:01APCs were generated with HPV 16 E6(29-38) peptide (TIHDIILECV; SEQ ID NO:233) or E7(11-19) peptide (YMLDLQPET; SEQ ID NO:236). Autologous CD8+ T cells from normal human donors are incubated over multiple rounds with the peptide-pulsed cells, and selections were carried out based on binding to peptide-loaded autologous MHC tetramers.

In some aspects, cells were subjected to multiple, such as a total of two or three or more, rounds of stimulation, in the presence of peptide-pulsed cells (such as with a particular peptide concentration of 1000 ng/mL maintained over the three rounds). Following one or more of, such as following the first and/or following the second and third rounds of stimulation, cells were sorted by flow cytometry into populations positive and negative, respectively, for binding to peptide-MHC tetramers containing the appropriate tetramer. Cells of the tetramer-positive and negative populations following each or one or more of of the one or more, such as the second and third, rounds in some aspects are subjected to single-cell TCR sequencing, to assess the presence and frequency of individual TCRs in the different populations, and the persistence of TCR clones over multiple rounds of antigen stimulation.

In some aspects, cell populations from the positive and negative fractions (i.e., sorted by flow cytometry based on positive and negative staining, respectively, for binding to the relevant antigen such as peptide-MHC such as loaded tetramers, e.g., as determined by flow cytometry), following the one or more rounds, are subject to high-throughput single-cell sequencing for TCR alpha and beta chain pairs.

High throughput single cell TCR sequencing in some aspects is performed as generally described in published PCT patent applications, publication numbers WO2012/048340, WO2012/048341 and WO2016/044227. The sequencing methods thus in some aspects employ single-cell droplets and sample and molecular barcodes, to identify individual pairs of TCR alpha and beta chain sequences at a single-cell level, for each of a large number (e.g., millions) of single cells present in a single starting composition, and to assess abundance of each TCR pair in various populations assessed. The ability to identify and quantify TCR pairs at a single-cell level in some embodiments permits the assessment of the frequency of each of various TCR pairs in each of the individual positive and negative fractions, and to assess enrichment and persistence of TCRs over multiple rounds of antigen stimulation.

In some aspects, the methods generate, identify, isolate and/or select TCR pairs that are enriched in antigen-binding, e.g., peptide-binding, fractions following at least one and in some aspects a plurality of, multiple rounds of stimulation. In some aspects, the TCRs are present in and/or present at a desired abundance in and/or preferentially enriched following, rounds 1, 2 and/or and 3 and in some aspects at least multiple rounds, of antigen exposure. In some aspects, the TCRs are enriched in the population over time following multiple rounds of exposure to antigen. Also provided are TCRs generated or identified using such methods, such as TCRs having such properties, such as the ability to survive and/or expand over multiple rounds of antigen exposure, such as in a peptide-pulsed APC assay.

IV. Engineered Cells

Also provided are cells such as cells that have been engineered to contain the binding molecule described herein. Also provided are populations of such cells, compositions containing such cells and/or enriched for such cells, such as in which cells expressing the binding molecule make up at least 15%, 20%, 25%, 30%, 35%, 40%, 50%, 60%, 70%, 80%, 90%, 91%, 92%, 93%, 94%, 95%, 96%, 97%, 98%, 99%, or more percent of the total cells in the composition or cells of a certain type such as T cells or CD8+ or CD4+ cells. In some embodiments, the cells are primary T cells. Among the compositions are pharmaceutical compositions and formulations for administration, such as for adoptive cell therapy. Also provided are therapeutic methods for administering the cells and compositions to subjects, e.g., patients.

Thus also provided are genetically engineered cells expressing the binding molecules. The cells generally are eukaryotic cells, such as mammalian cells, and typically are human cells. In some embodiments, the cells are derived from the blood, bone marrow, lymph, or lymphoid organs, are cells of the immune system, such as cells of the innate or adaptive immunity, e.g., myeloid or lymphoid cells, including lymphocytes, typically T cells and/or NK cells. Other exemplary cells include stem cells, such as multipotent and pluripotent stem cells, including induced pluripotent stem cells (iPSCs). The cells typically are primary cells, such as those isolated directly from a subject and/or isolated from a subject and frozen. In some embodiments, the cells include one or more subsets of T cells or other cell types, such as whole T cell populations, CD4+ cells, CD8+ cells, and subpopulations thereof, such as those defined by function, activation state, maturity, potential for differentiation, expansion, recirculation, localization, and/or persistence capacities, antigen-specificity, type of antigen receptor, presence in a particular organ or compartment, marker or cytokine secretion profile, and/or degree of differentiation. With reference to the subject to be treated, the cells may be allogeneic and/or autologous. Among the methods include off-the-shelf methods. In some aspects, such as for off-the-shelf technologies, the cells are pluripotent and/or multipotent, such as stem cells, such as induced pluripotent stem cells (iPSCs). In some embodiments, the methods include isolating cells from the subject, preparing, processing, culturing, and/or engineering them, as described herein, and re-introducing them into the same patient, before or after cryopreservation.

Among the sub-types and subpopulations of T cells and/or of CD4+ and/or of CD8+ T cells are naïve T ($T_N$) cells, effector T cells ($T_{EFF}$), memory T cells and sub-types thereof, such as stem cell memory T ($T_{SCM}$), central memory T ($T_{CM}$), effector memory T ($T_{EM}$), or terminally differentiated effector memory T cells, tumor-infiltrating lymphocytes (TIL), immature T cells, mature T cells, helper T cells, cytotoxic T cells, mucosa-associated invariant T (MALT) cells, naturally occurring and adaptive regulatory T (Treg) cells, helper T cells, such as TH1 cells, TH2 cells, TH3 cells, TH17 cells, TH9 cells, TH22 cells, follicular helper T cells, alpha/beta T cells, and delta/gamma T cells.

In some embodiments, the cells are natural killer (NK) cells. In some embodiments, the cells are monocytes or granulocytes, e.g., myeloid cells, macrophages, neutrophils, dendritic cells, mast cells, eosinophils, and/or basophils.

In some embodiments, the cells include one or more nucleic acids introduced via genetic engineering, and thereby express recombinant or genetically engineered products of such nucleic acids. In some embodiments, the nucleic acids are heterologous, i.e., normally not present in a cell or sample obtained from the cell, such as one obtained from another organism or cell, which for example, is not ordinarily found in the cell being engineered and/or an organism from which such cell is derived. In some embodiments, the nucleic acids are not naturally occurring, such as a nucleic acid not found in nature, including one comprising chimeric combinations of nucleic acids encoding various domains from multiple different cell types.

In some embodiments, genes and/or gene products (and/or expression thereof) in the provided cells, and/or compositions containing such cells, are reduced, deleted, eliminated, knocked-out or disrupted. Such genes and/or gene products in some aspects include one or more of the gene encoding (or product thereof) TCR alpha constant region (TRAC) and/or TCR beta constant region (TRBC; encoded in humans by TRBC1 or TRBC2), e.g., to reduce or prevent expression of the endogenous TCR in the cell, e.g. T cell, and/or α chain thereof. In some embodiments, the genes and/or gene products, such as TRAC and/or TRBC, is reduced, deleted, eliminated, knocked-out or disrupted in any of the engineered cells provided herein and/or in any of the methods for producing engineered cells provided herein. In some embodiments, engineered cells and/or engineered cells produced by the methods are cells that have been engineered to express the binding molecule described herein, populations of such cells, compositions containing such cells and/or enriched for such cells. In some embodiments, genes and/or gene products, such as the TRAC and/or TRBC, is reduced, deleted, eliminated, knocked-out or disrupted in primary T cells, to reduce, delete, eliminate, knock-out or disrupt the expression of the endogenous TCR in primary T cells, e.g., that are engineered to express any of the binding molecules, e.g., TCRs, described herein.

In some embodiments, the genes and/or gene products targeted for reduction, deletion, elimination, knock-out or disruption are endogenous genes encoding the TCR or α chain, a domain and/or a region thereof. In some embodiments, a target site for disruption is in a T cell receptor alpha constant (TRAC) gene. In some embodiments, a target site for disruption is in a T cell receptor beta constant 1 (TRBC1) or T cell receptor beta constant 2 (TRBC2) gene. In some embodiments, the one or more target site(s) is in a TRAC gene and one or both of a TRBC1 and a TRBC2 gene.

In some embodiments, the endogenous TCR Cα is encoded by the TRAC gene (IMGT nomenclature). An exemplary nucleotide sequence of the human T cell receptor alpha constant chain (TRAC) gene locus is set forth in SEQ ID NO: 348 (NCBI Reference Sequence: NG 001332.3, TRAC). In some embodiments, the endogenous TCR Cβ is encoded by TRBC1 or TRBC2 genes (IMGT nomenclature). An exemplary nucleotide sequence of the human T cell receptor beta constant chain 1 (TRBC1) gene locus is set forth in SEQ ID NO:349 (NCBI Reference Sequence: NG 001333.2, TRBC1); and an exemplary nucleotide sequence of the human T cell receptor beta constant chain 2 (TRBC2) gene locus is set forth in SEQ ID NO:1047 (NCBI Reference Sequence: NG 001333.2, TRBC2).

In some embodiments, gene(s) targeted for disruption or knock-out is at or near one or more of the TRAC, TRBC1 and/or TRBC2 loci. In some embodiments, the TRAC gene is knocked out. In some embodiments, the TRBC1 gene is knocked out. In some embodiments, the TRBC2 gene is knocked out. In some embodiments, the TRAC gene and the TRBC1 gene are knocked out. In some embodiments, the TRAC gene and the TRBC2 gene are knocked out. In some embodiments, the TRAC gene and both the TRBC1 and TRBC2 genes are knocked out, e.g., targeting a sequence that is conserved between TRBC1 and TRBC2.

In some embodiments, reducing or preventing endogenous TCR expression can lead to a reduced risk or chance of mispairing between chains of the engineered TCR and the endogenous TCR, thereby creating a new TCR that could potentially result in a higher risk of undesired or unintended antigen recognition and/or side effects, and/or could reduce expression levels of the desired exogenous TCR. In some aspects, reducing or preventing endogenous TCR expression can increase expression of the engineered TCR in the cells as compared to cells in which expression of the TCR is not reduced or prevented, such as increased by 1.5-fold, 2-fold, 3-fold, 4-fold, 5-fold or more. For example, in some cases, suboptimal expression of an engineered or recombinant TCR can occur due to competition with an endogenous TCR and/or with TCRs having mispaired chains, for the invariant CD3 signaling molecules that are involved in permitting expression of the complex on the cell surface.

In some embodiments, the reduction, deletion, elimination, knockout or disruption involve the use of one or more agent(s) capable of introducing a genetic disruption, a cleavage, a double strand break (DSB) and/or a nick at a target site in the genomic DNA, resulting in a the reduction, deletion, elimination, knockout or disruption after repair by various cellular DNA repair mechanisms.

In some embodiments, the one or more agent(s) capable of introducing a cleavage comprises a DNA binding protein or DNA-binding nucleic acid that specifically binds to or hybridizes to a target site in the genome, e.g., in TRAC and/or TRBC genes. In some aspects, the targeted cleavage, e.g., DNA break, of the endogenous genes encoding TCR is achieved using a protein or a nucleic acid is coupled to or complexed with a gene editing nuclease, such as in a chimeric or fusion protein. In some embodiments, the one or more agent(s) capable of introducing a cleavage comprises a fusion protein comprising a DNA-targeting protein and a nuclease or an RNA-guided nuclease.

In some embodiments, reduction, deletion, elimination, knockout or disruption is carried out by gene editing methods, such as using a zinc finger nuclease (ZFN), TALEN or a CRISPR/Cas system with an engineered single guide RNA that cleaves a TCR gene. In some embodiments, reducing expression of an endogenous TCR is carried out using an inhibitory nucleic acid molecule against a target nucleic acids encoding specific TCRs (e.g., TCR-α and TCR-β). In some embodiments, the inhibitory nucleic acid is or contains or encodes a small interfering RNA (siRNA), a microRNA-adapted shRNA, a short hairpin RNA (shRNA), a hairpin siRNA, a microRNA (miRNA-precursor) or a microRNA (miRNA). Exemplary methods for reducing or preventing endogenous TCR expression are known in the art, see e.g. U.S. Pat. No. 9,273,283; U.S. publication no. US2014/0301990; and PCT publication No. WO2015/161276.

In some embodiments, the agent capable of introducing a targeted cleavage comprises various components, such as a fusion protein comprising a DNA-targeting protein and a nuclease or an RNA-guided nuclease. In some embodiments, the targeted cleavage is carried out using a DNA-targeting molecule that includes a DNA-binding protein such as one or more zinc finger protein (ZFP) or transcription activator-like effectors (TALEs), fused to a nuclease, such as an endonuclease. In some embodiments, the targeted cleavage is carried out using RNA-guided nucleases such as a clustered regularly interspaced short palindromic nucleic acid (CRISPR)-associated nuclease (Cas) system (including Cas and/or Cfp1). In some embodiments, the targeted cleavage is carried using agents capable of introducing a cleavage, such as sequence-specific or targeted nucleases, including DNA-binding targeted nucleases and gene editing nucleases such as zinc finger nucleases (ZFN) and transcription activator-like effector nucleases (TALENs), and RNA-guided nucleases such as a CRISPR-associated nuclease (Cas) system, specifically engineered and/or designed to be targeted to the at least one target site(s), sequence of a gene or a portion thereof.

In some embodiments, the one or more agent(s) specifically targets the at least one target site(s), e.g., at or near TRAC and/or TRBC genes. In some embodiments, the agent comprises a ZFN, TALEN or a CRISPR/Cas9 combination that specifically binds to, recognizes, or hybridizes to the target site(s). In some embodiments, the CRISPR/Cas9 system includes an engineered crRNA/tracr RNA ("single guide RNA") to guide specific cleavage. In some embodiments, the agent comprises nucleases based on the Argonaute system (e.g., from T. thermophilus, known as 'TtAgo', (Swarts et at (2014) Nature 507(7491): 258-261).

Zinc finger proteins (ZFPs), transcription activator-like effectors (TALEs), and CRISPR system binding domains can be "engineered" to bind to a predetermined nucleotide sequence, for example via engineering (altering one or more amino acids) of the recognition helix region of a naturally occurring ZFP or TALE protein. Engineered DNA binding proteins (ZFPs or TALEs) are proteins that are non-naturally occurring. Rational criteria for design include application of substitution rules and computerized algorithms for processing information in a database storing information of existing ZFP and/or TALE designs and binding data. See, e.g., U.S. Pat. Nos. 6,140,081; 6,453,242; and 6,534,261; see also WO 98/53058; WO 98/53059; WO 98/53060; WO 02/016536 and WO 03/016496 and U.S. Publication No. 20110301073.

Exemplary ZFNs, TALEs, and TALENs are described in, e.g., Lloyd et al., Frontiers in Immunology, 4(221): 1-7 (2013).

In some embodiments, the TRAC and/or TRBC genes can be targeted for cleavage by engineered ZFNs. Exemplary ZFN that target endogenous T cell receptor (TCR) genes include those described in, e.g., US 2015/0164954, US 2011/0158957, U.S. Pat. No. 8,956,828 and Torikawa et al. (2012) Blood 119:5697-5705, the disclosures of which are incorporated by reference in their entireties.

In some embodiments, the TRAC and/or TRBC genes can be targeted for cleavage by engineered TALENs. Exemplary TALEN that target endogenous T cell receptor (TCR) genes include those described in, e.g., WO 2017/070429, WO 2015/136001, US20170016025 and US20150203817, the disclosures of which are incorporated by reference in their entireties.

In some embodiments, the TRAC and/or TRBC genes can be targeted for cleavage using clustered regularly interspaced short palindromic repeats (CRISPR) and CRISPR-associated (Cas) proteins. See Sander and Joung, Nature Biotechnology, 32(4): 347-355. In some embodiments, "CRISPR system" refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), and/or other sequences and transcripts from a CRISPR locus.

In some aspects, the CRISPR/Cas nuclease or CRISPR/Cas nuclease system includes a non-coding guide RNA (gRNA), which sequence-specifically binds to DNA, and a Cas protein (e.g., Cas9), with nuclease functionality.

In some embodiments, the CRISPR/Cas nuclease system comprises at least one of: a guide RNA (gRNA) having a targeting domain that is complementary with a target site of a TRAC gene; a gRNA having a targeting domain that is complementary with a target site of one or both of a TRBC1 and a TRBC2 gene; or at least one nucleic acid encoding the gRNA.

In general, a guide sequence, e.g., guide RNA, is any polynucleotide sequences comprising at least a sequence portion, e.g., targeting domain, that has sufficient complementarity with a target site sequence, such as a target site in the TRAC, TRBC1 and/or TRBC2 genes in humans, to hybridize with the target sequence at the target site and direct sequence-specific binding of the CRISPR complex to the target sequence. In some embodiments, in the context of formation of a CRISPR complex, "target site" (also known as "target position," "target DNA sequence" or "target location") generally refers to a sequence to which a guide sequence is designed to have complementarity, where hybridization between the target sequence and a domain, e.g., targeting domain, of the guide RNA promotes the formation of a CRISPR complex. Full complementarity is not necessarily required, provided there is sufficient complementarity to cause hybridization and promote formation of a CRISPR complex. Generally, a guide sequence is selected to reduce the degree of secondary structure within the guide sequence. Secondary structure may be determined by any suitable polynucleotide folding algorithm.

In some aspects, a CRISPR enzyme (e.g. Cas9 nuclease) in combination with (and optionally complexed with) a guide sequence is delivered to the cell. For example, one or more elements of a CRISPR system is derived from a type I, type II, or type III CRISPR system. For example, one or more elements of a CRISPR system are derived from a particular organism comprising an endogenous CRISPR system, such as *Streptococcus pyogenes, Staphylococcus aureus* or *Neisseria meningitides.*

In some embodiments, a guide RNA (gRNA) specific to the target site (e.g. TRAC, TRBC1 and/or TRBC2 in humans) is used to RNA-guided nucleases, e.g., Cas, to introduce a DNA break at the target site or target position. Methods for designing gRNAs and exemplary targeting domains can include those described in, e.g., in International PCT Publication No. WO2015/161276. Targeting domains of can be incorporated into the gRNA that is used to target Cas9 nucleases to the target site or target position. Methods for selection and validation of target sequences as well as off-target analyses are described, e.g., in Mali et al., 2013 Science 339(6121): 823-826; Hsu et al. Nat Biotechnol, 31(9): 827-32; Fu et al., 2014 Nat Biotechnol; Heigwer et al., 2014 Nat Methods 11(2):122-3; Bae et al., 2014 Bioinformatics; Xiao A et al., 2014 Bioinformatics. A genome-wide gRNA database for CRISPR genome editing is publicly available, which contains exemplary single guide RNA (sgRNA) sequences targeting constitutive exons of genes in the human genome or mouse genome (see e.g., genescript-.com/gRNA-database.html; see also, Sanjana et al. (2014) Nat. Methods, 11:783-4). In some aspects, the gRNA sequence is or comprises a sequence with minimal off-target binding to a non-target site or position.

In some embodiments, the gRNA for targeting TRAC, TRBC1 and/or TRBC2 can be any that are described herein, or are described elsewhere. In some embodiments, the sequence targeted by the CRISPR/Cas9 gRNA in the TRAC gene locus is ATTCACCGATTTTGATTCTC (SEQ ID NO:1182). In some embodiments, the sequence targeted by the CRISPR/Cas9 gRNA in the TRBC1 and/or TRBC2 gene loci is GATCGTCAGCGCCGAGGCC (SEQ ID NO:1054). In some embodiments, the gRNA targeting domain sequence for targeting a target site in the TRAC gene locus is GAGAAUCAAAAUCGGUGAAU (SEQ ID NO: 1048). In some embodiments, the gRNA targeting domain sequence for targeting a target site in the TRBC1 and/or TRBC2 gene loci is GGCCUCGGCGCUGACGAUCU (SEQ ID NO: 1053). Other exemplary gRNA sequences, or targeting domains contained in the gRNA and/or other methods of gene editing and/or knock-out targeting endogenous TCR genes, e.g., TRAC and/or TRBC genes, include any described in, e.g., in International PCT Publication Nos. WO2015/161276, WO2014/191128, WO2015/136001, WO2016/069283, WO2016/016341; U.S. Publication Nos. US2011/0158957, US2014/0301990, US2015/0098954 and US2016/0208243; and Osborn et al. (2016) Mol. Ther. 24(3):570-581. Any of the known methods can be used to generate a cleavage of the endogenous genes encoding TCR domains or regions can be used in the embodiments provided herein, e.g., for engineering in cell lines and/or in primary T cells.

In some embodiments, t reduction, deletion, elimination, knockout or disruption of the endogenous genes encoding TCR, such as TRAC and TRBC1 or TRBC2, is carried out by delivering or introducing one or more agent(s) capable of introducing a cleavage, e.g., Cas9 and/or gRNA components, to a cell, using any of a number of known delivery method or vehicle for introduction or transfer to cells, for example, using lentiviral delivery vectors, or any of the known methods or vehicles for delivering Cas9 molecules and gRNAs. Exemplary methods are described in, e.g., Wang et al. (2012) *J. Immunother.* 35(9): 689-701; Cooper et al. (2003) *Blood.* 101:1637-1644; Verhoeyen et al. (2009) *Methods Mol Biol.* 506: 97-114; and Cavalieri et al. (2003) *Blood.* 102(2): 497-505. In some embodiments, nucleic acid sequences encoding one or more components of one or more agent(s) capable of introducing a cleavage, e.g., DNA break, is introduced into the cells, e.g., by any methods for introducing nucleic acids into a cell described herein or known. In some embodiments, a vector encoding components of one or more agent(s) capable of introducing a cleavage such as a CRISPR guide RNA and/or a Cas9 enzyme can be delivered into the cell.

In some embodiments, the one or more agent(s) capable of introducing a cleavage, e.g., a Cas9/gRNA system, is introduced into the cell as a ribonucleoprotein (RNP) complex. RNP complexes include a sequence of ribonucleotides, such as an RNA or a gRNA molecule, and a protein, such as a Cas9 protein or variant thereof. For example, the Cas9 protein is delivered as RNP complex that comprises a Cas9 protein and a gRNA molecule targeting the target sequence, e.g., using electroporation or other physical delivery method. In some embodiments, the RNP is delivered into the cell via electroporation or other physical means, e.g., particle gun, calcium phosphate transfection, cell compression or squeezing. In some embodiments, the RNP can cross the plasma membrane of a cell without the need for additional delivery agents (e.g., small molecule agents, lipids, etc.).

A. Preparation of Cells for Genetic Engineering

In some embodiments, preparation of the engineered cells includes one or more culture and/or preparation steps. The cells for introduction of the binding molecule, e.g., TCR or CAR, may be isolated from a sample, such as a biological sample, e.g., one obtained from or derived from a subject. In some embodiments, the subject from which the cell is isolated is one having the disease or condition or in need of a cell therapy or to which cell therapy will be administered. The subject in some embodiments is a human in need of a particular therapeutic intervention, such as the adoptive cell therapy for which cells are being isolated, processed, and/or engineered.

Accordingly, the cells in some embodiments are primary cells, e.g., primary human cells. The samples include tissue, fluid, and other samples taken directly from the subject, as well as samples resulting from one or more processing steps, such as separation, centrifugation, genetic engineering (e.g. transduction with viral vector), washing, and/or incubation. The biological sample can be a sample obtained directly from a biological source or a sample that is processed. Biological samples include, but are not limited to, body fluids, such as blood, plasma, serum, cerebrospinal fluid, synovial fluid, urine and sweat, tissue and organ samples, including processed samples derived therefrom.

In some aspects, the sample from which the cells are derived or isolated is blood or a blood-derived sample, or is or is derived from an apheresis or leukapheresis product. Exemplary samples include whole blood, peripheral blood mononuclear cells (PBMCs), leukocytes, bone marrow, thymus, tissue biopsy, tumor, leukemia, lymphoma, lymph node, gut associated lymphoid tissue, mucosa associated lymphoid tissue, spleen, other lymphoid tissues, liver, lung, stomach, intestine, colon, kidney, pancreas, breast, bone, prostate, cervix, testes, ovaries, tonsil, or other organ, and/or cells derived therefrom. Samples include, in the context of cell therapy, e.g., adoptive cell therapy, samples from autologous and allogeneic sources.

In some embodiments, the cells are derived from cell lines, e.g., T cell lines. The cells in some embodiments are obtained from a xenogeneic source, for example, from mouse, rat, non-human primate, or pig.

In some embodiments, isolation of the cells includes one or more preparation and/or non-affinity based cell separation steps. In some examples, cells are washed, centrifuged, and/or incubated in the presence of one or more reagents, for example, to remove unwanted components, enrich for desired components, lyse or remove cells sensitive to particular reagents. In some examples, cells are separated based on one or more property, such as density, adherent properties, size, sensitivity and/or resistance to particular components.

In some examples, cells from the circulating blood of a subject are obtained, e.g., by apheresis or leukapheresis. The samples, in some aspects, contain lymphocytes, including T cells, monocytes, granulocytes, B cells, other nucleated white blood cells, red blood cells, and/or platelets, and in some aspects contains cells other than red blood cells and platelets.

In some embodiments, the blood cells collected from the subject are washed, e.g., to remove the plasma fraction and to place the cells in an appropriate buffer or media for subsequent processing steps. In some embodiments, the cells are washed with phosphate buffered saline (PBS). In some embodiments, the wash solution lacks calcium and/or magnesium and/or many or all divalent cations. In some aspects, a washing step is accomplished a semi-automated "flow-through" centrifuge (for example, the Cobe 2991 cell processor, Baxter) according to the manufacturer's instructions. In some aspects, a washing step is accomplished by tangential flow filtration (TFF) according to the manufacturer's instructions. In some embodiments, the cells are resuspended in a variety of biocompatible buffers after washing, such as, for example, $Ca^{++}/Mg^{++}$ free PBS. In certain embodiments, components of a blood cell sample are removed and the cells directly resuspended in culture media.

In some embodiments, the methods include density-based cell separation methods, such as the preparation of white blood cells from peripheral blood by lysing the red blood cells and centrifugation through a Percoll or Ficoll gradient.

In some embodiments, the isolation methods include the separation of different cell types based on the expression or presence in the cell of one or more specific molecules, such as surface markers, e.g., surface proteins, intracellular markers, or nucleic acid. In some embodiments, any known method for separation based on such markers may be used. In some embodiments, the separation is affinity- or immunoaffinity-based separation. For example, the isolation in some aspects includes separation of cells and cell populations based on the cells' expression or expression level of one or more markers, typically cell surface markers, for example, by incubation with an antibody or binding partner that specifically binds to such markers, followed generally by washing steps and separation of cells having bound the antibody or binding partner, from those cells having not bound to the antibody or binding partner.

Such separation steps can be based on positive selection, in which the cells having bound the reagents are retained for further use, and/or negative selection, in which the cells having not bound to the antibody or binding partner are retained. In some examples, both fractions are retained for further use. In some aspects, negative selection can be particularly useful where no antibody is available that specifically identifies a cell type in a heterogeneous population, such that separation is best carried out based on markers expressed by cells other than the desired population.

The separation need not result in 100% enrichment or removal of a particular cell population or cells expressing a particular marker. For example, positive selection of or enrichment for cells of a particular type, such as those expressing a marker, refers to increasing the number or percentage of such cells, but need not result in a complete absence of cells not expressing the marker. Likewise, negative selection, removal, or depletion of cells of a particular type, such as those expressing a marker, refers to decreasing the number or percentage of such cells, but need not result in a complete removal of all such cells.

In some examples, multiple rounds of separation steps are carried out, where the positively or negatively selected fraction from one step is subjected to another separation step, such as a subsequent positive or negative selection. In some examples, a single separation step can deplete cells expressing multiple markers simultaneously, such as by incubating cells with a plurality of antibodies or binding partners, each specific for a marker targeted for negative selection. Likewise, multiple cell types can simultaneously be positively selected by incubating cells with a plurality of antibodies or binding partners expressed on the various cell types.

For example, in some aspects, specific subpopulations of T cells, such as cells positive or expressing high levels of one or more surface markers, e.g., $CD28^+$, $CD62L^+$, $CCR7^+$, $CD27^+$, $CD127^+$, $CD4^+$, $CD8^+$, $CD45RA^+$, and/or $CD45RO^+$ T cells, are isolated by positive or negative selection techniques.

For example, $CD3^+$, $CD28^+$ T cells can be positively selected using anti-CD3/anti-CD28 conjugated magnetic beads (e.g., DYNABEADS® M-450 CD3/CD28 T Cell Expander).

In some embodiments, isolation is carried out by enrichment for a particular cell population by positive selection, or depletion of a particular cell population, by negative selection. In some embodiments, positive or negative selection is accomplished by incubating cells with one or more antibodies or other binding agent that specifically bind to one or more surface markers expressed or expressed ($marker^+$) at a relatively higher level ($marker^{high}$) on the positively or negatively selected cells, respectively.

In some embodiments, T cells are separated from a PBMC sample by negative selection of markers expressed on non-T cells, such as B cells, monocytes, or other white blood cells, such as CD14. In some aspects, a $CD4^+$ or $CD8^+$ selection step is used to separate $CD4^+$ helper and $CD8^+$ cytotoxic T cells. Such $CD4^+$ and $CD8^+$ populations can be further sorted into sub-populations by positive or negative selection for markers expressed or expressed to a relatively higher degree on one or more naive, memory, and/or effector T cell subpopulations.

In some embodiments, $CD8^+$ cells are further enriched for or depleted of naive, central memory, effector memory, and/or central memory stem cells, such as by positive or negative selection based on surface antigens associated with the respective subpopulation. In some embodiments, enrichment for central memory T ($T_{CM}$) cells is carried out to increase efficacy, such as to improve long-term survival, expansion, and/or engraftment following administration, which in some aspects is particularly robust in such subpopulations. See Terakura et al. (2012) Blood.1:72-82; Wang et al. (2012) *J Immunother.* 35(9):689-701. In some embodiments, combining $T_{CM}$-enriched $CD8^+$ T cells and $CD4^+$ T cells further enhances efficacy.

In embodiments, memory T cells are present in both $CD62L^+$ and $CD62L^-$ subsets of $CD8^+$ peripheral blood lymphocytes. PBMC can be enriched for or depleted of $CD62L^-CD8^+$ and/or $CD62L^+CD8^+$ fractions, such as using anti-CD8 and anti-CD62L antibodies.

In some embodiments, the enrichment for central memory T ($T_{CM}$) cells is based on positive or high surface expression of CD45RO, CD62L, CCR7, CD28, CD3, and/or CD 127; in some aspects, it is based on negative selection for cells expressing or highly expressing CD45RA and/or granzyme B. In some aspects, isolation of a $CD8^+$ population enriched for $T_{cm}$ cells is carried out by depletion of cells expressing CD4, CD14, CD45RA, and positive selection or enrichment for cells expressing CD62L. In one aspect, enrichment for central memory T (TQM) cells is carried out starting with a negative fraction of cells selected based on CD4 expression, which is subjected to a negative selection based on expression of CD14 and CD45RA, and a positive selection based on CD62L. Such selections in some aspects are carried out simultaneously and in other aspects are carried out sequentially, in either order. In some aspects, the same CD4 expression-based selection step used in preparing the $CD8^+$ cell population or subpopulation, also is used to generate the $CD4^+$ cell population or sub-population, such that both the positive and negative fractions from the CD4-based separation are retained and used in subsequent steps of the methods, optionally following one or more further positive or negative selection steps.

In a particular example, a sample of PBMCs or other white blood cell sample is subjected to selection of $CD4^+$ cells, where both the negative and positive fractions are retained. The negative fraction then is subjected to negative selection based on expression of CD14 and CD45RA, and positive selection based on a marker characteristic of central memory T cells, such as CD62L or CCR7, where the positive and negative selections are carried out in either order.

$CD4^+$ T helper cells are sorted into naïve, central memory, and effector cells by identifying cell populations that have cell surface antigens. $CD4^+$ lymphocytes can be obtained by standard methods. In some embodiments, naive $CD4^+$ T lymphocytes are $CD45RO^-$, $CD45RA^+$, $CD62L^+$, $CD4^+$ T cells. In some embodiments, central memory $CD4^+$ cells are $CD62L^+$ and $CD45RO^+$. In some embodiments, effector $CD4^+$ cells are $CD62L^-$ and $CD45RO^-$.

In one example, to enrich for $CD4^+$ cells by negative selection, a monoclonal antibody cocktail typically includes antibodies to CD14, CD20, CD11b, CD16, HLA-DR, and CD8. In some embodiments, the antibody or binding partner is bound to a solid support or matrix, such as a magnetic bead or paramagnetic bead, to allow for separation of cells for positive and/or negative selection. For example, in some embodiments, the cells and cell populations are separated or isolated using immunomagnetic (or affinitymagnetic) separation techniques (reviewed in Methods in Molecular Medicine, vol. 58: Metastasis Research Protocols, Vol. 2: Cell Behavior In Vitro and In Vivo, p 17-25 Edited by: S. A. Brooks and U. Schumacher© Humana Press Inc., Totowa, N.J.).

In some aspects, the sample or composition of cells to be separated is incubated with small, magnetizable or magnetically responsive material, such as magnetically responsive particles or microparticles, such as paramagnetic beads (e.g., such as Dynalbeads or MACS beads). The magnetically responsive material, e.g., particle, generally is directly or indirectly attached to a binding partner, e.g., an antibody, that specifically binds to a molecule, e.g., surface marker, present on the cell, cells, or population of cells that it is desired to separate, e.g., that it is desired to negatively or positively select.

In some embodiments, the magnetic particle or bead comprises a magnetically responsive material bound to a specific binding member, such as an antibody or other binding partner. There are many well-known magnetically responsive materials used in magnetic separation methods. Suitable magnetic particles include those described in Molday, U.S. Pat. No. 4,452,773, and in European Patent Specification EP 452342 B, which are hereby incorporated by reference. Colloidal sized particles, such as those described in Owen U.S. Pat. No. 4,795,698, and Liberti et al., U.S. Pat. No. 5,200,084 are other examples.

The incubation generally is carried out under conditions whereby the antibodies or binding partners, or molecules, such as secondary antibodies or other reagents, which specifically bind to such antibodies or binding partners, which are attached to the magnetic particle or bead, specifically bind to cell surface molecules if present on cells within the sample.

In some aspects, the sample is placed in a magnetic field, and those cells having magnetically responsive or magnetizable particles attached thereto will be attracted to the magnet and separated from the unlabeled cells. For positive selection, cells that are attracted to the magnet are retained; for negative selection, cells that are not attracted (unlabeled cells) are retained. In some aspects, a combination of positive and negative selection is performed during the same selection step, where the positive and negative fractions are retained and further processed or subject to further separation steps.

In certain embodiments, the magnetically responsive particles are coated in primary antibodies or other binding partners, secondary antibodies, lectins, enzymes, or streptavidin. In certain embodiments, the magnetic particles are attached to cells via a coating of primary antibodies specific for one or more markers. In certain embodiments, the cells, rather than the beads, are labeled with a primary antibody or binding partner, and then cell-type specific secondary antibody- or other binding partner (e.g., streptavidin)-coated magnetic particles, are added. In certain embodiments, streptavidin-coated magnetic particles are used in conjunction with biotinylated primary or secondary antibodies.

In some embodiments, the magnetically responsive particles are left attached to the cells that are to be subsequently incubated, cultured and/or engineered; in some aspects, the particles are left attached to the cells for administration to a patient. In some embodiments, the magnetizable or magnetically responsive particles are removed from the cells. Methods for removing magnetizable particles from cells are known and include, e.g., the use of competing non-labeled antibodies, magnetizable particles or antibodies conjugated to cleavable linkers, etc. In some embodiments, the magnetizable particles are biodegradable.

In some embodiments, the affinity-based selection is via magnetic-activated cell sorting (MACS) (Miltenyi Biotec, Auburn, Calif.). Magnetic Activated Cell Sorting (MACS) systems are capable of high-purity selection of cells having magnetized particles attached thereto. In certain embodiments, MACS operates in a mode wherein the non-target and target species are sequentially eluted after the application of the external magnetic field. That is, the cells attached to magnetized particles are held in place while the unattached species are eluted. Then, after this first elution step is completed, the species that were trapped in the magnetic field and were prevented from being eluted are freed in some manner such that they can be eluted and recovered. In certain embodiments, the non-target cells are labelled and depleted from the heterogeneous population of cells.

In certain embodiments, the isolation or separation is carried out using a system, device, or apparatus that carries out one or more of the isolation, cell preparation, separation, processing, incubation, culture, and/or formulation steps of the methods. In some aspects, the system is used to carry out each of these steps in a closed or sterile environment, for example, to minimize error, user handling and/or contamination. In one example, the system is a system as described in International Patent Application, Publication Number WO2009/072003, or US 2011/0003380 A1.

In some embodiments, the system or apparatus carries out one or more, e.g., all, of the isolation, processing, engineering, and formulation steps in an integrated or self-contained system, and/or in an automated or programmable fashion. In some aspects, the system or apparatus includes a computer and/or computer program in communication with the system or apparatus, which allows a user to program, control, assess the outcome of, and/or adjust various aspects of the processing, isolation, engineering, and formulation steps.

In some aspects, the separation and/or other steps is carried out using CliniMACS system (Miltenyi Biotec), for example, for automated separation of cells on a clinical-scale level in a closed and sterile system. Components can include an integrated microcomputer, magnetic separation unit, peristaltic pump, and various pinch valves. The integrated computer in some aspects controls all components of the instrument and directs the system to perform repeated procedures in a standardized sequence. The magnetic separation unit in some aspects includes a movable permanent magnet and a holder for the selection column. The peristaltic pump controls the flow rate throughout the tubing set and, together with the pinch valves, ensures the controlled flow of buffer through the system and continual suspension of cells.

The CliniMACS system in some aspects uses antibody-coupled magnetizable particles that are supplied in a sterile, non-pyrogenic solution. In some embodiments, after labelling of cells with magnetic particles the cells are washed to remove excess particles. A cell preparation bag is then connected to the tubing set, which in turn is connected to a bag containing buffer and a cell collection bag. The tubing set consists of pre-assembled sterile tubing, including a pre-column and a separation column, and are for single use only. After initiation of the separation program, the system automatically applies the cell sample onto the separation column. Labelled cells are retained within the column, while unlabeled cells are removed by a series of washing steps. In some embodiments, the cell populations for use with the methods described herein are unlabeled and are not retained in the column. In some embodiments, the cell populations for use with the methods described herein are labeled and are retained in the column. In some embodiments, the cell populations for use with the methods described herein are eluted from the column after removal of the magnetic field, and are collected within the cell collection bag.

In certain embodiments, separation and/or other steps are carried out using the CliniMACS Prodigy system (Miltenyi Biotec). The CliniMACS Prodigy system in some aspects is equipped with a cell processing unity that permits automated washing and fractionation of cells by centrifugation. The CliniMACS Prodigy system can also include an onboard camera and image recognition software that determines the optimal cell fractionation endpoint by discerning the macroscopic layers of the source cell product. For example, peripheral blood may be automatically separated into erythrocytes, white blood cells and plasma layers. The CliniMACS Prodigy system can also include an integrated cell cultivation chamber which accomplishes cell culture protocols such as, e.g., cell differentiation and expansion, antigen loading, and long-term cell culture. Input ports can allow for the sterile removal and replenishment of media and cells can be monitored using an integrated microscope. See, e.g., Klebanoff et al. (2012) *J Immunother.* 35(9): 651-660, Terakuraet al. (2012) Blood.1:72-82, and Wang et al. (2012) *J Immunother.* 35(9):689-701.

In some embodiments, a cell population described herein is collected and enriched (or depleted) via flow cytometry, in which cells stained for multiple cell surface markers are carried in a fluidic stream. In some embodiments, a cell population described herein is collected and enriched (or depleted) via preparative scale (FACS)-sorting. In certain embodiments, a cell population described herein is collected and enriched (or depleted) by use of microelectromechanical systems (MEMS) chips in combination with a FACS-based detection system (see, e.g., WO 2010/033140, Cho et al. (2010) *Lab Chip* 10, 1567-1573; and Godin et al. (2008) J Biophoton. 1(5):355-376. In both cases, cells can be labeled with multiple markers, allowing for the isolation of well-defined T cell subsets at high purity.

In some embodiments, the antibodies or binding partners are labeled with one or more detectable marker, to facilitate separation for positive and/or negative selection. For example, separation may be based on binding to fluorescently labeled antibodies. In some examples, separation of cells based on binding of antibodies or other binding partners specific for one or more cell surface markers are carried in a fluidic stream, such as by fluorescence-activated cell sorting (FACS), including preparative scale (FACS) and/or microelectromechanical systems (MEMS) chips, e.g., in combination with a flow-cytometric detection system. Such methods allow for positive and negative selection based on multiple markers simultaneously.

In some embodiments, the preparation methods include steps for freezing, e.g., cryopreserving, the cells, either before or after isolation, incubation, and/or engineering. In some embodiments, the freeze and subsequent thaw step removes granulocytes and, to some extent, monocytes in the cell population. In some embodiments, the cells are suspended in a freezing solution, e.g., following a washing step to remove plasma and platelets. Any of a variety of known freezing solutions and parameters in some aspects may be used. One example involves using PBS containing 20% DMSO and 8% human serum albumin (HSA), or other suitable cell freezing media. This is then diluted 1:1 with media so that the final concentration of DMSO and HSA are 10% and 4%, respectively. The cells are then frozen to −80° C. at a rate of 1° per minute and stored in the vapor phase of a liquid nitrogen storage tank.

In some embodiments, the provided methods include cultivation, incubation, culture, and/or genetic engineering steps. For example, in some embodiments, provided are methods for incubating and/or engineering the depleted cell populations and culture-initiating compositions.

Thus, in some embodiments, the cell populations are incubated in a culture-initiating composition. The incubation and/or engineering may be carried out in a culture vessel, such as a unit, chamber, well, column, tube, tubing set, valve, vial, culture dish, bag, or other container for culture or cultivating cells.

In some embodiments, the cells are incubated and/or cultured prior to or in connection with genetic engineering.

The incubation steps can include culture, cultivation, stimulation, activation, and/or propagation. In some embodiments, the compositions or cells are incubated in the presence of stimulating conditions or a stimulatory agent. Such conditions include those designed to induce proliferation, expansion, activation, and/or survival of cells in the population, to mimic antigen exposure, and/or to prime the cells for genetic engineering, such as for the introduction of an antigen receptor.

The conditions can include one or more of particular media, temperature, oxygen content, carbon dioxide content, time, agents, e.g., nutrients, amino acids, antibiotics, ions, and/or stimulatory factors, such as cytokines, chemokines, antigens, binding partners, fusion proteins, recombinant soluble receptors, and any other agents designed to activate the cells.

In some embodiments, the stimulating conditions or agents include one or more agent, e.g., ligand, which is capable of activating an intracellular signaling domain of a TCR complex. In some aspects, the agent turns on or initiates TCR/CD3 intracellular signaling cascade in a T cell. Such agents can include antibodies, such as those specific for a TCR component and/or costimulatory receptor, e.g., anti-CD3. In some embodiments, the stimulating conditions include one or more agent, e.g. ligand, which is capable of stimulating a costimulatory receptor, e.g., anti-CD28. In some embodiments, such agents and/or ligands may be, bound to solid support such as a bead, and/or one or more cytokines. Optionally, the expansion method may further comprise the step of adding anti-CD3 and/or anti CD28 antibody to the culture medium (e.g., at a concentration of at least about 0.5 ng/ml). In some embodiments, the stimulating agents include IL-2, IL-15 and/or IL-7. In some aspects, the IL-2 concentration is at least about 10 units/mL.

In some aspects, incubation is carried out in accordance with techniques such as those described in U.S. Pat. No. 6,040,177 to Riddell et al., Klebanoff et al. (2012) J Immunother. 35(9): 651-660, Terakurael. (2012) Blood.1:72-82, and/or Wang et al. (2012) J Immunother. 35(9):689-701.

In some embodiments, the T cells are expanded by adding to the culture-initiating composition feeder cells, such as non-dividing peripheral blood mononuclear cells (PBMC), (e.g., such that the resulting population of cells contains at least about 5, 10, 20, or 40 or more PBMC feeder cells for each T lymphocyte in the initial population to be expanded); and incubating the culture (e.g. for a time sufficient to expand the numbers of T cells). In some aspects, the non-dividing feeder cells can comprise gamma-irradiated PBMC feeder cells. In some embodiments, the PBMC are irradiated with gamma rays in the range of about 3000 to 3600 rads to prevent cell division. In some aspects, the feeder cells are added to culture medium prior to the addition of the populations of T cells.

In some embodiments, the stimulating conditions include temperature suitable for the growth of human T lymphocytes, for example, at least about 25 degrees Celsius, generally at least about 30 degrees, and generally at or about 37 degrees Celsius. Optionally, the incubation may further comprise adding non-dividing EBV-transformed lymphoblastoid cells (LCL) as feeder cells. LCL can be irradiated with gamma rays in the range of about 6000 to 10,000 rads. The LCL feeder cells in some aspects is provided in any suitable amount, such as a ratio of LCL feeder cells to initial T lymphocytes of at least about 10:1.

In embodiments, antigen-specific T cells, such as antigen-specific CD4+ and/or CD8+ T cells, are obtained by stimulating naive or antigen specific T lymphocytes with antigen. For example, antigen-specific T cell lines or clones can be generated to cytomegalovirus antigens by isolating T cells from infected subjects and stimulating the cells in vitro with the same antigen.

B. Vectors and Methods for Genetic Engineering

Also provided are methods, nucleic acids, compositions, and kits, for expressing the binding molecules, and for producing the genetically engineered cells expressing such binding molecules. The genetic engineering generally involves introduction of a nucleic acid encoding the binding molecule, e.g. TCR or CAR, e.g. TCR-like CAR, into the cell, such as by retroviral transduction, transfection, or transformation.

In some embodiments, gene transfer is accomplished by first stimulating the cell, such as by combining it with a stimulus that induces a response such as proliferation, survival, and/or activation, e.g., as measured by expression of a cytokine or activation marker, followed by transduction of the activated cells, and expansion in culture to numbers sufficient for clinical applications.

In some contexts, overexpression of a stimulatory factor (for example, a lymphokine or a cytokine) may be toxic to a subject. Thus, in some contexts, the engineered cells include gene segments that cause the cells to be susceptible to negative selection in vivo, such as upon administration in adoptive immunotherapy. For example in some aspects, the cells are engineered so that they can be eliminated as a result of a change in the in vivo condition of the patient to which they are administered. The negative selectable phenotype may result from the insertion of a gene that confers sensitivity to an administered agent, for example, a compound. Negative selectable genes include the Herpes simplex virus type I thymidine kinase (HSV-I TK) gene (Wigler et al., Cell 2:223, 1977) which confers ganciclovir sensitivity; the cellular hypoxanthine phosphribosyltransferase (HPRT) gene, the cellular adenine phosphoribosyltransferase (APRT) gene, bacterial cytosine deaminase, (Mullen et al., Proc. Natl. Acad. Sci. USA. 89:33 (1992)).

In some aspects, the cells further are engineered to promote expression of cytokines or other factors. Various methods for the introduction of genetically engineered components are well known and may be used with the provided methods and compositions. Exemplary methods include those for transfer of nucleic acids encoding the binding molecules, including via viral, e.g., retroviral or lentiviral, transduction, transposons, and electroporation.

In some embodiments, recombinant nucleic acids are transferred into cells using recombinant infectious virus particles, such as, e.g., vectors derived from simian virus 40 (SV40), adenoviruses, adeno-associated virus (AAV). In some embodiments, recombinant nucleic acids are transferred into T cells using recombinant lentiviral vectors or retroviral vectors, such as gamma-retroviral vectors (see, e.g., Koste et al. (2014) Gene Therapy 2014 Apr. 3. doi: 10.1038/gt.2014.25; Carlens et al. (2000) Exp Hematol 28(10): 1137-46; Alonso-Camino et al. (2013) Mol Ther Nucl Acids 2, e93; Park et al., Trends Biotechnol. 2011 Nov. 29(11): 550-557.

In some embodiments, the retroviral vector has a long terminal repeat sequence (LTR), e.g., a retroviral vector derived from the Moloney murine leukemia virus (MoMLV), myeloproliferative sarcoma virus (MPSV), murine embryonic stem cell virus (MESV), murine stem cell virus (MSCV), spleen focus forming virus (SFFV), or adeno-associated virus (AAV). Most retroviral vectors are derived from murine retroviruses. In some embodiments, the retroviruses include those derived from any avian or mammalian cell source. The retroviruses typically are amphotropic, meaning that they are capable of infecting host cells of several species, including humans. In one embodiment, the gene to be expressed replaces the retroviral gag, pol and/or env sequences. A number of illustrative retroviral systems have been described (e.g., U.S. Pat. Nos. 5,219,740; 6,207, 453; 5,219,740; Miller and Rosman (1989) BioTechniques 7:980-990; Miller, A. D. (1990) Human Gene Therapy 1:5-14; Scarpa et al. (1991) Virology 180:849-852; Burns et al. (1993) Proc. Natl. Acad. Sci. USA 90:8033-8037; and Boris-Lawrie and Temin (1993) Cur. Opin. Genet. Develop. 3:102-109.

Methods of lentiviral transduction are known. Exemplary methods are described in, e.g., Wang et al. (2012) *J. Immunother.* 35(9): 689-701; Cooper et al. (2003) *Blood.* 101: 1637-1644; Verhoeyen et al. (2009) *Methods Mol Biol.* 506: 97-114; and Cavalieri et al. (2003) Blood. 102(2): 497-505.

In some embodiments, recombinant nucleic acids are transferred into T cells via electroporation (see, e.g., Chicaybam et al, (2013) *PLoS ONE* 8(3): e60298 and Van Tedeloo et al. (2000) *Gene Therapy* 7(16): 1431-1437). In some embodiments, recombinant nucleic acids are transferred into T cells via transposition (see, e.g., Manuri et al. (2010) Hum Gene Ther 21(4): 427-437; Sharma et al. (2013) *Molec Ther Nucl Acids* 2, e74; and Huang et al. (2009) *Methods Mol Biol* 506: 115-126). Other methods of introducing and expressing genetic material in immune cells include calcium phosphate transfection (e.g., as described in Current Protocols in Molecular Biology, John Wiley & Sons, New York. N.Y.), protoplast fusion, cationic liposome-mediated transfection; tungsten particle-facilitated microparticle bombardment (Johnston, Nature, 346: 776-777 (1990)); and strontium phosphate DNA co-precipitation (Brash et al., Mol. Cell Biol., 7: 2031-2034 (1987)).

Other approaches and vectors for transfer of the nucleic acids encoding the binding molecules or recombinant products are those described, e.g., in international patent application, Publication No.: WO2014/055668, and U.S. Pat. No. 7,446,190.

Among additional nucleic acids, e.g., genes for introduction are those to improve the efficacy of therapy, such as by promoting viability and/or function of transferred cells; genes to provide a genetic marker for selection and/or evaluation of the cells, such as to assess in vivo survival or localization; genes to improve safety, for example, by making the cell susceptible to negative selection in vivo as described by Lupton S. D. et al., *Mol. and Cell Biol.,* 11:6 (1991); and Riddell et al., *Human Gene Therapy* 3:319-338 (1992); see also the publications of PCT/US91/08442 and PCT/US94/05601 by Lupton et al. describing the use of bifunctional selectable fusion genes derived from fusing a dominant positive selectable marker with a negative selectable marker. See, e.g., Riddell et al., U.S. Pat. No. 6,040,177, at columns 14-17.

Thus, provided in some embodiments are engineered cells, such as those containing a binding molecule (such as TCR or antigen-binding fragment thereof or antibody or antigen-binding fragment thereof), nucleic acid, or vector as described herein. In some aspects, the cell is produced by transducing the cell in vitro or ex vivo with a vector described herein. In some aspects, the cell is a T cell, such as a CD8+ or CD4+ T cell. In some embodiments, the binding molecule is heterologous to the cell.

In some cases, the engineered cell contains a heterologous TCR or antigen-binding fragment thereof that recognizes or binds a peptide epitope derived from HPV16 E6. In some cases, the TCR or antigen-binding fragment thereof does not recognize or bind the epitope E6(29-38) comprising the amino acid sequence TIHDIILECV (SEQ ID NO. 233). In some instances, the TCR or antigen-binding fragment thereof that recognizes or binds a peptide epitope derived from HPV16 E6 is or comprises the sequence set forth in SEQ ID NO: 232 or SEQ ID NO: 234.

In some embodiments, the engineered cell contains a heterologous TCR or antigen-binding fragment thereof that recognizes or binds a peptide epitope derived from HPV16 E7. In some embodiments, the TCR or antigen-binding fragment thereof does not recognize or bind the epitope E7 (11-19) comprising the amino acid sequence YMLDLQPET (SEQ ID NO. 236). In some instances, the TCR or antigen-binding fragment thereof that recognizes or binds a peptide epitope derived from HPV16 E7 is or contains the sequence set forth in any of SEQ ID NOs: 235-239. In some cases, the peptide derived from HPV16 E7 is or contains the sequence set forth in SEQ ID NO: 235.

V. Compositions, Methods, and Uses

Also provided are compositions including the binding molecules, e.g. TCRs, and engineered cells, including pharmaceutical compositions and formulations, and methods of using and uses of the molecules and compositions, such as in the treatment of diseases, conditions, and disorders in which HPV16 E6 or E7 is expressed, and/or detection, diagnostic, and prognostic methods.

A. Pharmaceutical Compositions and Formulations

Provided are pharmaceutical formulations including the binding molecules, e.g., TCR or antigen binding fragment thereof or antibody or antigen-binding fragment thereof, and/or the engineered cells expressing the binding molecules. The pharmaceutical compositions and formulations generally include one or more optional pharmaceutically acceptable carrier or excipient. In some embodiments, the composition includes at least one additional therapeutic agent.

The term "pharmaceutical formulation" refers to a preparation which is in such form as to permit the biological activity of an active ingredient contained therein to be effective, and which contains no additional components which are unacceptably toxic to a subject to which the formulation would be administered.

A "pharmaceutically acceptable carrier" refers to an ingredient in a pharmaceutical formulation, other than an active ingredient, which is nontoxic to a subject. A pharmaceutically acceptable carrier includes, but is not limited to, a buffer, excipient, stabilizer, or preservative.

In some aspects, the choice of carrier is determined in part by the particular cell or binding molecule, and/or by the method of administration. Accordingly, there are a variety of suitable formulations. For example, the pharmaceutical composition can contain preservatives. Suitable preservatives may include, for example, methylparaben, propylparaben, sodium benzoate, and benzalkonium chloride. In some aspects, a mixture of two or more preservatives is used. The preservative or mixtures thereof are typically present in an amount of about 0.0001% to about 2% by weight of the total composition. Carriers are described, e.g., by Remington's Pharmaceutical Sciences 16th edition, Osol, A. Ed. (1980). Pharmaceutically acceptable carriers are generally nontoxic to recipients at the dosages and concentrations employed, and include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG).

Buffering agents in some aspects are included in the compositions. Suitable buffering agents include, for example, citric acid, sodium citrate, phosphoric acid, potassium phosphate, and various other acids and salts. In some aspects, a mixture of two or more buffering agents is used. The buffering agent or mixtures thereof are typically present in an amount of about 0.001% to about 4% by weight of the total composition. Methods for preparing administrable pharmaceutical compositions are known. Exemplary methods are described in more detail in, for example, Remington: The Science and Practice of Pharmacy, Lippincott Williams & Wilkins; 21st ed. (May 1, 2005).

Formulations of the binding molecules can include lyophilized formulations and aqueous solutions. The formulation or composition may also contain more than one active ingredient useful for the particular indication, disease, or condition being treated with the binding molecules or cells, preferably those with activities complementary to the binding molecule or cell, where the respective activities do not adversely affect one another. Such active ingredients are suitably present in combination in amounts that are effective for the purpose intended. Thus, in some embodiments, the pharmaceutical composition further includes other pharmaceutically active agents or drugs, such as chemotherapeutic agents, e.g., asparaginase, busulfan, carboplatin, cisplatin, daunorubicin, doxorubicin, fluorouracil, gemcitabine, hydroxyurea, methotrexate, paclitaxel, rituximab, vinblastine, vincristine, etc. In some embodiments, the cells or binding molecules are administered in the form of a salt, e.g., a pharmaceutically acceptable salt. Suitable pharmaceutically acceptable acid addition salts include those derived from mineral acids, such as hydrochloric, hydrobromic, phosphoric, metaphosphoric, nitric, and sulphuric acids, and organic acids, such as tartaric, acetic, citric, malic, lactic, fumaric, benzoic, glycolic, gluconic, succinic, and arylsulphonic acids, for example, p-toluenesulphonic acid.

Active ingredients may be entrapped in microcapsules, in colloidal drug delivery systems (for example, liposomes, albumin microspheres, microemulsions, nano-particles and nanocapsules) or in macroemulsions. In certain embodiments, the pharmaceutical composition is formulated as an inclusion complex, such as cyclodextrin inclusion complex, or as a liposome. Liposomes can serve to target the host cells (e.g., T-cells or NK cells) to a particular tissue. Many methods are available for preparing liposomes, such as those described in, for example, Szoka et al., Ann. Rev. Biophys. Bioeng., 9: 467 (1980), and U.S. Pat. Nos. 4,235,871, 4,501,728, 4,837,028, and 5,019,369.

The pharmaceutical composition in some aspects can employ time-released, delayed release, and sustained release delivery systems such that the delivery of the composition occurs prior to, and with sufficient time to cause, sensitization of the site to be treated. Many types of release delivery systems are available and known. Such systems can avoid repeated administrations of the composition, thereby increasing convenience to the subject and the physician.

The pharmaceutical composition in some embodiments contains the binding molecules and/or cells in amounts effective to treat or prevent the disease or condition, such as a therapeutically effective or prophylactically effective amount. Therapeutic or prophylactic efficacy in some embodiments is monitored by periodic assessment of treated subjects. For repeated administrations over several days or longer, depending on the condition, the treatment is repeated until a desired suppression of disease symptoms occurs. However, other dosage regimens may be useful and can be determined. The desired dosage can be delivered by a single bolus administration of the composition, by multiple bolus administrations of the composition, or by continuous infusion administration of the composition.

In certain embodiments, in the context of genetically engineered cells containing the binding molecules, a subject is administered the range of about one million to about 100 billion cells, such as, e.g., 1 million to about 50 billion cells (e.g., about 5 million cells, about 25 million cells, about 500 million cells, about 1 billion cells, about 5 billion cells, about 20 billion cells, about 30 billion cells, about 40 billion cells, or a range defined by any two of the foregoing values), such as about 10 million to about 100 billion cells (e.g., about 20 million cells, about 30 million cells, about 40 million cells, about 60 million cells, about 70 million cells, about 80 million cells, about 90 million cells, about 10 billion cells, about 25 billion cells, about 50 billion cells, about 75 billion cells, about 90 billion cells, or a range defined by any two of the foregoing values), and in some cases about 100 million cells to about 50 billion cells (e.g., about 120 million cells, about 250 million cells, about 350 million cells, about 450 million cells, about 650 million cells, about 800 million cells, about 900 million cells, about 3 billion cells, about 30 billion cells, about 45 billion cells) or any value in between these ranges, and/or such a number of cells per kilogram of body weight of the subject.

The cells or binding molecules may be administered using standard administration techniques, formulations, and/or devices. Provided are formulations and devices, such as syringes and vials, for storage and administration of the compositions. Administration of the cells can be autologous or heterologous. For example, immunoresponsive cells or progenitors can be obtained from one subject, and administered to the same subject or a different, compatible subject. Peripheral blood derived immunoresponsive cells or their progeny (e.g., in vivo, ex vivo or in vitro derived) can be administered via localized injection, including catheter administration, systemic injection, localized injection, intravenous injection, or parenteral administration. When administering a therapeutic composition (e.g., a pharmaceutical composition containing a genetically modified immunoresponsive cell), it will generally be formulated in a unit dosage injectable form (solution, suspension, emulsion).

Formulations include those for oral, intravenous, intraperitoneal, subcutaneous, pulmonary, transdermal, intramuscular, intranasal, buccal, sublingual, or suppository administration. In some embodiments, the cell populations are administered parenterally. The term "parenteral," as used herein, includes intravenous, intramuscular, subcutaneous, rectal, vaginal, intracranial, intrathoracic, and intraperitoneal administration. In some embodiments, the cell populations are administered to a subject using peripheral systemic delivery by intravenous, intraperitoneal, or subcutaneous injection.

Compositions in some embodiments are provided as sterile liquid preparations, e.g., isotonic aqueous solutions, suspensions, emulsions, dispersions, or viscous compositions, which may in some aspects be buffered to a selected pH. Liquid preparations are normally easier to prepare than gels, other viscous compositions, and solid compositions. Additionally, liquid compositions are somewhat more convenient to administer, especially by injection. Viscous compositions, on the other hand, can be formulated within the appropriate viscosity range to provide longer contact periods with specific tissues. Liquid or viscous compositions can comprise carriers, which can be a solvent or dispersing medium containing, for example, water, saline, phosphate buffered saline, polyol (for example, glycerol, propylene glycol, liquid polyethylene glycol) and suitable mixtures thereof.

Sterile injectable solutions can be prepared by incorporating the binding molecule in a solvent, such as in admixture with a suitable carrier, diluent, or excipient such as sterile water, physiological saline, glucose, dextrose, or the like. The compositions can also be lyophilized. The compositions can contain auxiliary substances such as wetting, dispersing, or emulsifying agents (e.g., methylcellulose), pH buffering agents, gelling or viscosity enhancing additives, preservatives, flavoring agents, colors, and the like, depending upon the route of administration and the preparation desired. Standard texts may in some aspects be consulted to prepare suitable preparations.

Various additives which enhance the stability and sterility of the compositions, including antimicrobial preservatives, antioxidants, chelating agents, and buffers, can be added. Prevention of the action of microorganisms can be ensured by various antibacterial and antifungal agents, for example, parabens, chlorobutanol, phenol, sorbic acid, and the like. Prolonged absorption of the injectable pharmaceutical form can be brought about by the use of agents delaying absorption, for example, aluminum monostearate and gelatin.

Sustained-release preparations may be prepared. Suitable examples of sustained-release preparations include semipermeable matrices of solid hydrophobic polymers containing the antibody, which matrices are in the form of shaped articles, e.g. films, or microcapsules.

The formulations to be used for in vivo administration are generally sterile. Sterility may be readily accomplished, e.g., by filtration through sterile filtration membranes.

B. Therapeutic and Prophylactic Methods and Uses

Also provided are methods of administering and uses, such as therapeutic and prophylactic uses, of the binding molecules, including TCRs and antigen-binding fragments thereof and antibodies or antigen-binding fragments thereof, and/or engineered cells expressing the binding molecules. Such methods and uses include therapeutic methods and uses, for example, involving administration of the molecules, cells, or compositions containing the same, to a subject having a disease, condition, or disorder expressing or associated with HPV, e.g., HPV16, and/or in which cells or tissues express, e.g., specifically express, HPV16, e.g., HPV16 E6 or E7. In some embodiments, the molecule, cell, and/or composition is administered in an effective amount to effect treatment of the disease or disorder. Uses include uses of the binding molecules and cells in such methods and treatments, and in the preparation of a medicament in order to carry out such therapeutic methods. In some embodiments, the methods are carried out by administering the binding molecules or cells, or compositions comprising the same, to the subject having, having had, or suspected of having the disease or condition. In some embodiments, the methods thereby treat the disease or condition or disorder in the subject.

As used herein, "treatment" (and grammatical variations thereof such as "treat" or "treating") refers to complete or partial amelioration or reduction of a disease or condition or disorder, or a symptom, adverse effect or outcome, or phenotype associated therewith. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. The terms do not imply complete curing of a disease or complete elimination of any symptom or effect(s) on all symptoms or outcomes.

As used herein, "delaying development of a disease" means to defer, hinder, slow, retard, stabilize, suppress and/or postpone development of the disease (such as cancer). This delay can be of varying lengths of time, depending on the history of the disease and/or individual being treated. As is evident to one skilled in the art, a sufficient or significant delay can, in effect, encompass prevention, in that the individual does not develop the disease. For example, a late stage cancer, such as development of metastasis, may be delayed.

"Preventing," as used herein, includes providing prophylaxis with respect to the occurrence or recurrence of a disease in a subject that may be predisposed to the disease but has not yet been diagnosed with the disease. In some embodiments, the provided molecules and compositions are used to delay development of a disease or to slow the progression of a disease.

As used herein, to "suppress" a function or activity is to reduce the function or activity when compared to otherwise same conditions except for a condition or parameter of interest, or alternatively, as compared to another condition. For example, a binding molecule or composition or cell which suppresses tumor growth reduces the rate of growth of the tumor compared to the rate of growth of the tumor in the absence of the binding molecule or composition or cell.

An "effective amount" of an agent, e.g., a pharmaceutical formulation, binding molecule, or cells, or composition, in the context of administration, refers to an amount effective, at dosages/amounts and for periods of time necessary, to achieve a desired result, such as a therapeutic or prophylactic result.

A "therapeutically effective amount" of an agent, e.g., a pharmaceutical formulation, binding molecule, or cells, refers to an amount effective, at dosages and for periods of time necessary, to achieve a desired therapeutic result, such as for treatment of a disease, condition, or disorder, and/or pharmacokinetic or pharmacodynamic effect of the treatment. The therapeutically effective amount may vary according to factors such as the disease state, age, sex, and weight of the subject, and the populations of cells administered. In some embodiments, the provided methods involve administering the binding molecules, cells, and/or compositions at effective amounts, e.g., therapeutically effective amounts.

A "prophylactically effective amount" refers to an amount effective, at dosages and for periods of time necessary, to achieve the desired prophylactic result. Typically but not necessarily, since a prophylactic dose is used in subjects prior to or at an earlier stage of disease, the prophylactically effective amount will be less than the therapeutically effective amount.

As used herein, a "subject" is a mammal, such as a human or other animal, and typically is human.

Among the diseases to be treated are cancers, typically HPV-associated cancers, and any HPV-associated, e.g., HPV 16-associated, diseases or conditions or diseases or conditions in which an HPV oncoprotein, e.g., E6 or E7, such as an HPV 16 oncoprotein, e.g., HPV 16 E6 or E7 is expressed. In certain diseases and conditions, the viral protein such as the oncoprotein such as the HPV 16 E6 or E7 is expressed in or by malignant cells and cancers, and/or a peptide epitope thereof is expressed on such malignant cancers or tissues, such as by way of MHC presentation. In some embodiments, the disease or condition is an HPV16-expressing cancer. In some embodiments, the cancer is a carcinoma, melanoma or other precancerous or cancerous state caused by or otherwise associated with HPV, such as HPV-16. In some embodiments, the carcinoma can be a squamous cell or adenocarionma. In some embodiments, the disease or condition can be characterized by an epithelial cell abnormality associated with oncogenic HPV infection, such as koilocytosis; hyperkeratosis; precancerous conditions encompasssing intraepithelial neoplasias or intraepithelial lesion; high-grade dysplasias; and invasive or malignant cancers. Among the HPV 16-associated diseases or conditions that can be treated include, but are not limited to, cervical cancer, uterine cancer, anal cancer, colorectal cancer, vaginal cancer, vulvar cancer, penile cancer, oropharyngeal cancers, tonsil cancer, pharyngeal cancers (pharynx cancer), laryngeal cancer (larynx cancer), oral cancer, skin cancer, esophageal cancer, head and neck cancer such as a squamous cell carcinoma (SCC) head and neck cancer, or small cell lung cancer. In some embodiments, the disease or condition is a cervical carcinoma.

In some embodiments, the methods may include steps or features to identify a subject who has, is suspected to have, or is at risk for developing an HPV 16-associated disease or disorder (see e.g. U.S. Pat. Nos. 6,355,424 and 8,968,995) and/or the subject to be treated may be a subject identified to have or to be so at risk for having or developing such HPV-associated disease or condition or cancer. Hence, provided in some aspects are methods for identifying subjects with diseases or disorders associated with HPV 16 E6 or E7 expression and selecting them for treatment and/or treating such subjects, e.g., selectively treating such subjects, with a provided HPV 16 binding molecule, including in some aspects with cells engineered to express such binding molecules, including in some aspects any of the HPV 16 E6 or E7 TCRs or antigen binding fragments thereof or anti-HPV 16 E6 or E7 antibodies, e.g., antibody fragments and proteins containing the same, such as the chimeric receptors, e.g., TCR-like CARs, and/or engineered cells expressing the TCRs or CARs.

For example, a subject may be screened for the presence of a disease or disorder associated with HPV 16 E6 or E7 expression, such as an HPV 16 E6- or E7-expressing cancer.

In some embodiments, the methods include screening for or detecting the presence of an HPV 16 E6- or E7-associated disease, e.g. a tumor. Thus, in some aspects, a sample may be obtained from a patient suspected of having a disease or disorder associated with HPV 16 E6 or E7 expression and assayed for the expression level of HPV 16 E6 or E7. In some aspects, a subject who tests positive for an HPV 16 E6- or E7-associated disease or disorder may be selected for treatment by the present methods, and may be administered a therapeutically effective amount of a binding molecule described herein, a CAR expressing such a binding molecule, cells containing the binding molecule, or a pharmaceutical composition thereof as described herein. In some embodiments, the methods can be used to monitor the size or density of an HPV 16 E6- or E7-expressing tissue, e.g. tumor, over time, e.g., before, during, or after treatment by the methods. In some aspects, subjects treated by methods provided herein have been selected or tested positive for HPV expression according to such methods, e.g., prior to initiation of or during treatment.

In some embodiments, administration of a provided HPV 16 binding molecule, including any of the HPV 16 E6 or E7 TCRs or antigen binding fragments thereof or anti-HPV 16 E6 or E7 antibodies, e.g., antibody fragments and proteins containing the same, such as the chimeric receptors, e.g., TCR-like CARs, and/or engineered cells expressing the TCRs or CARs, can be combined with another therapeutic for the treatment of an HPV disease. For example, the additional therapeutic treatment can include treatment with another anti-cancer agent for the treatment of cervical cancer. Suitable dosages for such a co-administered agent may be lowered due to the combined action (synergy) of the agent and the provide HPV 16 binding molecule.

In some embodiments, the subject has persistent or relapsed disease, e.g., following treatment with another HPV 16-specific binding molecule and/or cells expressing an HPV 16-targeting binding molecule and/or other therapy, including chemotherapy, radiation, and/or hematopoietic stem cell transplantation (HSCT), e.g., allogenic HSCT. In some embodiments, the administration effectively treats the subject despite the subject having become resistant to another HPV 16-targetetd therapy. In some embodiments, the subject has not relapsed but is determined to be at risk for relapse, such as at a high risk of relapse, and thus the compound or composition is administered prophylactically, e.g., to reduce the likelihood of or prevent relapse.

In some embodiments, the treatment does not induce an immune response by the subject to the therapy, and/or does not induce such a response to a degree that prevents effective treatment of the disease or condition. In some aspects, the degree of immunogenicity and/or graft versus host response is less than that observed with a different but comparable treatment. For example, in the case of adoptive cell therapy using cells expressing TCRs or CARs including the provided binding molecules, the degree of immunogenicity in some embodiments is reduced compared to TCRs or CARs including a different binding molecule.

In some embodiments, the methods include adoptive cell therapy, whereby genetically engineered cells expressing the provided binding molecules are administered to subjects. Such administration can promote activation of the cells (e.g., T cell activation) in an HPV 16-targeted manner, such that the cells of the disease or disorder are targeted for destruction.

Thus, the provided methods and uses include methods and uses for adoptive cell therapy. In some embodiments, the methods include administration of the cells or a composition containing the cells to a subject, tissue, or cell, such as one having, at risk for, or suspected of having the disease, condition or disorder. In some embodiments, the cells, populations, and compositions are administered to a subject having the particular disease or condition to be treated, e.g., via adoptive cell therapy, such as adoptive T cell therapy. In some embodiments, the cells or compositions are administered to the subject, such as a subject having or at risk for the disease or condition. In some aspects, the methods thereby treat, e.g., ameliorate one or more symptom of the disease or condition, such as by lessening tumor burden in an HPV 16 E6- or E7-expressing cancer.

Methods for administration of cells for adoptive cell therapy are known and may be used in connection with the provided methods and compositions. For example, adoptive T cell therapy methods are described, e.g., in US Patent Application Publication No. 2003/0170238 to Gruenberg et al; U.S. Pat. No. 4,690,915 to Rosenberg; Rosenberg (2011) Nat Rev Clin Oncol. 8(10):577-85). See, e.g., Themeli et al. (2013) Nat Biotechnol. 31(10): 928-933; Tsukahara et al. (2013) Biochem Biophys Res Commun 438(1): 84-9; Davila et al. (2013) PLoS ONE 8(4): e61338.

In some embodiments, the cell therapy, e.g., adoptive cell therapy, e.g., adoptive T cell therapy, is carried out by autologous transfer, in which the cells are isolated and/or otherwise prepared from the subject who is to receive the cell therapy, or from a sample derived from such a subject. Thus, in some aspects, the cells are derived from a subject, e.g., patient, in need of a treatment and the cells, following isolation and processing are administered to the same subject.

In some embodiments, the cell therapy, e.g., adoptive cell therapy, e.g., adoptive T cell therapy, is carried out by allogeneic transfer, in which the cells are isolated and/or otherwise prepared from a subject other than a subject who is to receive or who ultimately receives the cell therapy, e.g., a first subject. In such embodiments, the cells then are administered to a different subject, e.g., a second subject, of the same species. In some embodiments, the first and second subjects are genetically identical. In some embodiments, the first and second subjects are genetically similar. In some embodiments, the second subject expresses the same HLA class or supertype as the first subject.

In some embodiments, the subject, to whom the cells, cell populations, or compositions are administered, is a primate, such as a human. In some embodiments, the primate is a monkey or an ape. The subject can be male or female and can be any suitable age, including infant, juvenile, adolescent, adult, and geriatric subjects. In some embodiments, the subject is a non-primate mammal, such as a rodent. In some examples, the patient or subject is a validated animal model for disease, adoptive cell therapy, and/or for assessing toxic outcomes such as cytokine release syndrome (CRS).

The provided binding molecules, such as TCRs and antigen-binding fragments thereof and antibodies and antigen-binding fragments thereof, and cells expressing the same, can be administered by any suitable means, for example, by injection, e.g., intravenous or subcutaneous injections, intraocular injection, periocular injection, subretinal injection, intravitreal injection, trans-septal injection, subscleral injection, intrachoroidal injection, intracameral injection, subconjectval injection, subconjuntival injection, sub-Tenon's injection, retrobulbar injection, peribulbar injection, or posterior juxtascleral delivery. In some embodiments, they are administered by parenteral, intrapulmonary, and intranasal, and, if desired for local treatment, intralesional administration. Parenteral infusions include intramuscular, intravenous, intraarterial, intraperitoneal, intracranial, intrathoracic, or subcutaneous administration. Dosing and administration may depend in part on whether the administration is brief or chronic. Various dosing schedules include but are not limited to single or multiple administrations over various time-points, bolus administration, and pulse infusion.

For the prevention or treatment of disease, the appropriate dosage of the binding molecule or cell may depend on the type of disease to be treated, the type of binding molecule, the severity and course of the disease, whether the binding molecule is administered for preventive or therapeutic purposes, previous therapy, the patient's clinical history and response to the binding molecule, and the discretion of the attending physician. The compositions and molecules and cells are in some embodiments suitably administered to the patient at one time or over a series of treatments.

In certain embodiments, in the context of genetically engineered cells containing the binding molecules, a subject is administered the range of about one million to about 100 billion cells and/or that amount of cells per kilogram of body weight, such as, e.g., 1 million to about 50 billion cells (e.g., about 5 million cells, about 25 million cells, about 500 million cells, about 1 billion cells, about 5 billion cells, about 20 billion cells, about 30 billion cells, about 40 billion cells, or a range defined by any two of the foregoing values), such as about 10 million to about 100 billion cells (e.g., about 20 million cells, about 30 million cells, about 40 million cells, about 60 million cells, about 70 million cells, about 80 million cells, about 90 million cells, about 10 billion cells, about 25 billion cells, about 50 billion cells, about 75 billion cells, about 90 billion cells, or a range defined by any two of the foregoing values), and in some cases about 100 million cells to about 50 billion cells (e.g., about 120 million cells, about 250 million cells, about 350 million cells, about 450 million cells, about 650 million cells, about 800 million cells, about 900 million cells, about 3 billion cells, about 30 billion cells, about 45 billion cells) or any value in between these ranges and/or per kilogram of body weight. Again, dosages may vary depending on attributes particular to the disease or disorder and/or patient and/or other treatments.

In some embodiments, the binding molecules or cells are administered as part of a combination treatment, such as simultaneously with or sequentially with, in any order, another therapeutic intervention, such as another TCR, antibody or engineered cell or receptor or agent, such as a cytotoxic or therapeutic agent.

The cells or antibodies in some embodiments are co-administered with one or more additional therapeutic agents or in connection with another therapeutic intervention, either simultaneously or sequentially in any order. In some contexts, the cells are co-administered with another therapy sufficiently close in time such that the cell populations enhance the effect of one or more additional therapeutic agents, or vice versa. In some embodiments, the cells or antibodies are administered prior to the one or more additional therapeutic agents. In some embodiments, the cells or antibodies are administered after to the one or more additional therapeutic agents.

Once the cells are administered to a mammal (e.g., a human), the biological activity of the engineered cell populations and/or binding molecules in some aspects is measured by any of a number of known methods. Parameters to assess include specific binding of an engineered or natural T cell or other immune cell to antigen, in vivo, e.g., by imaging, or ex vivo, e.g., by ELISA or flow cytometry. In certain embodiments, the ability of the engineered cells to destroy target cells can be measured using any suitable method known in the art, such as cytotoxicity assays described in, for example, Kochenderfer et al., J. Immunotherapy, 32(7): 689-702 (2009), and Herman et al. J. Immunological Methods, 285(1): 25-40 (2004). In certain embodiments, the biological activity of the cells also can be measured by assaying expression and/or secretion of certain cytokines, such as CD 107a, IFNγ, IL-2, and TNF. In some aspects the biological activity is measured by assessing clinical outcome, such as reduction in tumor burden or load.

In certain embodiments, engineered cells are modified in any number of ways, such that their therapeutic or prophylactic efficacy is increased. For example, the engineered TCRs or antibody-expressing CARs expressed by the engineered cells in some embodiments are conjugated either directly or indirectly through a linker to a targeting moiety. The practice of conjugating compounds, e.g., the TCR or CAR, to targeting moieties is known in the art. See, for instance, Wadwa et al., J. Drug Targeting 3: 1 1 1 (1995), and U.S. Pat. No. 5,087,616.

C. Diagnostic and Detection Methods

Also provided are methods involving use of the provided binding molecules, e.g., TCRs or antigen-binding fragments thereof and antibodies and antigen-binding fragments thereof, in detection of HPV 16, e.g., HPV 16 E6 or HPV 16 E7, for example, in diagnostic and/or prognostic methods in association with a HPV 16-expressing disease or condition. The methods in some embodiments include incubating a biological sample with the binding molecule and/or administering the binding molecule to a subject. In certain embodiments, a biological sample includes a cell or tissue, such as tumor or cancer tissue. In certain binding molecule to a region or peptide epitope of HPV 16, e.g., HPV 16 E6 or E7, and detecting whether a complex is formed between the binding molecule and peptide epitope. Such a method may be an in vitro or in vivo method. In one embodiment, an anti-HPV 16 binding molecule is used to select subjects eligible for therapy with an anti-HPV 16 binding molecules or engineered cells comprising such molecules, e.g. where HPV 16, e.g., HPV 16 E6 or E7 is a biomarker for selection of patients.

In some embodiments, a sample, such as a cell, tissue sample, lysate, composition, or other sample derived therefrom is contacted with the binding molecule and binding or formation of a complex between the binding molecule and the sample (e.g., region or epitope of HPV16 in the sample) is determined or detected. When binding in the test sample is demonstrated or detected as compared to a reference cell of the same tissue type, it may indicate the presence of an associated disease or condition. In some embodiments, the sample is from human tissues.

Various methods known in the art for detecting specific binding molecule-antigen binding can be used. Exemplary immunoassays include fluorescence polarization immunoassay (FPIA), fluorescence immunoassay (FIA), enzyme immunoassay (EIA), nephelometric inhibition immunoassay (NIA), enzyme linked immunosorbent assay (ELISA), and radioimmunoassay (RIA). An indicator moiety, or label group, can be attached to the subject binding molecules and may be selected so as to meet the needs of various uses of the method which are often dictated by the availability of assay equipment and compatible immunoassay procedures. Exemplary labels include radionuclides (e.g. $^{125}$I, $^{131}$I, $^{35}$S, $^{3}$H, or $^{32}$P), enzymes (e.g., alkaline phosphatase, horseradish peroxidase, luciferase, or β-glactosidase), fluorescent moieties or proteins (e.g., fluorescein, rhodamine, phycoerythrin, GFP, or BFP), or luminescent moieties (e.g., Qdot™ nanoparticles supplied by the Quantum Dot Corporation, Palo Alto, Calif.). General techniques to be used in performing the various immunoassays noted above are known to those of ordinary skill in the art.

For purposes of diagnosis, the binding molecules can be labeled with a detectable moiety including but not limited to radioisotopes, fluorescent labels, and various enzyme-substrate labels know in the art. Methods of conjugating labels to binding molecules, e.g., TCRs or antibodies, are known in the art. In some embodiments, the binding molecules need not be labeled, and the presence thereof can be detected using a labeled antibody which binds to the binding molecules.

The provided binding molecules in some embodiments can be employed in any known assay method, such as competitive binding assays, direct and indirect sandwich assays, and immunoprecipitation assays. The binding molecules can also be used for in vivo diagnostic assays, such as in vivo imaging. Generally, the binding molecule is labeled with a radionuclide (such as $^{111}$In, $^{99}$Tc, $^{14}$C, $^{131}$I, $^{125}$I, or $^{3}$H) so that the cells or tissue of interest can be localized in vivo following administration to a subject. The binding molecule may also be used as staining reagent in pathology, e.g., using known techniques.

VI. Articles of Manufacture

Also provided are articles of manufacture containing the provided binding molecules, e.g., TCRs, antibodies, and CARs and/or engineered cells, and/or compositions. The articles of manufacture may include a container and a label or package insert on or associated with the container. Suitable containers include, for example, bottles, vials, syringes, IV solution bags, etc. The containers may be formed from a variety of materials such as glass or plastic. The container in some embodiments holds a composition which is by itself or combined with another composition effective for treating, preventing and/or diagnosing the condition. In some embodiments, the container has a sterile access port. Exemplary containers include an intravenous solution bags, vials, including those with stoppers pierceable by a needle for injection. The label or package insert may indicate that the composition is used for treating the HPV 16 E6- or E7-expressing or -associated disease or condition. The article of manufacture may include (a) a first container with a composition contained therein, wherein the composition includes the antibody or engineered antigen receptor; and (b) a second container with a composition contained therein, wherein the composition includes a further agent, such as a cytotoxic or otherwise therapeutic agent. The article of manufacture may further include a package insert indicating that the compositions can be used to treat a particular condition. Alternatively, or additionally, the article of manufacture may further include another or the same container comprising a pharmaceutically-acceptable buffer. It may further include other materials such as other buffers, diluents, filters, needles, and/or syringes.

VII. Definitions

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

The terms "polypeptide" and "protein" are used interchangeably to refer to a polymer of amino acid residues, and are not limited to a minimum length. Polypeptides, including the provided antibodies and antibody chains and other peptides, e.g., linkers, may include amino acid residues including natural and/or non-natural amino acid residues. The terms also include post-expression modifications of the polypeptide, for example, glycosylation, sialylation, acetylation, phosphorylation, and the like. In some aspects, the polypeptides may contain modifications with respect to a native or natural sequence, as long as the protein maintains the desired activity. These modifications may be deliberate, as through site-directed mutagenesis, or may be accidental, such as through mutations of hosts which produce the proteins or errors due to PCR amplification.

An "isolated" nucleic acid refers to a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location.

"Isolated nucleic acid encoding a TCR or an antibody" refers to one or more nucleic acid molecules encoding TCR alpha or beta chains (or fragments thereof) or antibody heavy and light chains (or fragments thereof), including such nucleic acid molecule(s) in a single vector or separate vectors, and such nucleic acid molecule(s) present at one or more locations in a host cell.

The terms "host cell," "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein.

As used herein, "percent (%) amino acid sequence identity" and "percent identity" when used with respect to an amino acid sequence (reference polypeptide sequence) is defined as the percentage of amino acid residues in a candidate sequence (e.g., the subject antibody or fragment) that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for aligning sequences, including any algorithms needed to achieve maximal alignment over the full length of the sequences being compared.

An amino acid substitution may include replacement of one amino acid in a polypeptide with another amino acid. Amino acid substitutions may be introduced into a binding molecule, e.g., TCR or antibody, of interest and the products screened for a desired activity, e.g., retained/improved antigen binding, decreased immunogenicity, or improved cytolytic activity.

Amino acids generally can be grouped according to the following common side-chain properties:
  (1) hydrophobic: Norleucine, Met, Ala, Val, Leu, Ile;
  (2) neutral hydrophilic: Cys, Ser, Thr, Asn, Gln;
  (3) acidic: Asp, Glu;
  (4) basic: His, Lys, Arg;
  (5) residues that influence chain orientation: Gly, Pro;
  (6) aromatic: Trp, Tyr, Phe.

In some embodiments, conservative substitutions can involve the exchange of a member of one of these classes for another member of the same class. In some embodiments, non-conservative amino acid substitutions can involve exchanging a member of one of these classes for another class.

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. Certain vectors are capable of directing the expression of nucleic acids to which they are operatively linked. Such vectors are referred to herein as "expression vectors."

The term "package insert" is used to refer to instructions customarily included in commercial packages of therapeutic products, that contain information about the indications, usage, dosage, administration, combination therapy, contraindications and/or warnings concerning the use of such therapeutic products.

As used herein, the singular forms "a," "an," and "the" include plural referents unless the context clearly dictates otherwise. For example, "a" or "an" means "at least one" or "one or more." It is understood that aspects and variations described herein include "consisting" and/or "consisting essentially of" aspects and variations.

Throughout this disclosure, various aspects of the claimed subject matter are presented in a range format. It should be understood that the description in range format is merely for convenience and brevity and should not be construed as an inflexible limitation on the scope of the claimed subject matter. Accordingly, the description of a range should be considered to have specifically disclosed all the possible sub-ranges as well as individual numerical values within that range. For example, where a range of values is provided, it is understood that each intervening value, between the upper and lower limit of that range and any other stated or intervening value in that stated range is encompassed within the claimed subject matter. The upper and lower limits of these smaller ranges may independently be included in the smaller ranges, and are also encompassed within the claimed subject matter, subject to any specifically excluded limit in the stated range. Where the stated range includes one or both of the limits, ranges excluding either or both of those included limits are also included in the claimed subject matter. This applies regardless of the breadth of the range.

The term "about" as used herein refers to the usual error range for the respective value readily known to the skilled person in this technical field. Reference to "about" a value or parameter herein includes (and describes) embodiments that are directed to that value or parameter per se. For example, description referring to "about X" includes description of "X".

As used herein, a composition refers to any mixture of two or more products, substances, or compounds, including cells. It may be a solution, a suspension, liquid, powder, a paste, aqueous, non-aqueous or any combination thereof.

As used herein, a statement that a cell or population of cells is "positive" for a particular marker refers to the detectable presence on or in the cell of a particular marker, typically a surface marker. When referring to a surface marker, the term refers to the presence of surface expression as detected by flow cytometry, for example, by staining with an antibody that specifically binds to the marker and detecting said antibody, wherein the staining is detectable by flow cytometry at a level substantially above the staining detected carrying out the same procedure with an isotype-matched control under otherwise identical conditions and/or at a level substantially similar to that for cell known to be positive for the marker, and/or at a level substantially higher than that for a cell known to be negative for the marker.

As used herein, a statement that a cell or population of cells is "negative" for a particular marker refers to the absence of substantial detectable presence on or in the cell of a particular marker, typically a surface marker. When referring to a surface marker, the term refers to the absence of surface expression as detected by flow cytometry, for example, by staining with an antibody that specifically binds to the marker and detecting said antibody, wherein the staining is not detected by flow cytometry at a level substantially above the staining detected carrying out the same procedure with an isotype-matched control under otherwise identical conditions, and/or at a level substantially lower than that for cell known to be positive for the marker, and/or at a level substantially similar as compared to that for a cell known to be negative for the marker.

All publications, including patent documents, scientific articles and databases, referred to in this application are incorporated by reference in their entirety for all purposes to the same extent as if each individual publication were individually incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

The section headings used herein are for organizational purposes only and are not to be construed as limiting the subject matter described.

VIII. Exemplary Embodiments

Among the provided embodiments are:
1. A binding molecule, comprising:
a first variable region comprising a complementarity determining region 3 (CDR-3) comprising an amino acid sequence set forth in any of SEQ ID NOs: 138, 144, 147, 153, 159, 163, 167, 173, 175, 301, 304, 308, 478, 493, 505, 511, 523, 539, 555, 572, 588, 600, 612, 624, 638, 650, 662, 679, 694, 712, 729, 744, 762, 776, 788, 802, 818, 832, 846, 858, 870, 882, 896, 911, 926, 940, 952, 964, 976, 988, or 1002, or a CDR3 contained within the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999; and/or
a second variable region comprising a complementarity determining region 3 (CDR-3) comprising an amino acid sequence set forth in any of SEQ ID NOs: 141, 146, 150, 156, 160, 164, 170, 174, 178, 305, 309, 486, 499, 517, 531, 548, 563, 581, 594, 606, 618, 630, 644, 656, 670, 686, 703, 721, 736, 753, 769, 782, 794, 809, 825, 840, 852, 864, 876, 888, 902, 919, 932, 946, 958, 970, 982, 994, or 1010, or a CDR3 contained within the amino acid sequence set forth in any of SEQ ID NOs: 112, 114, 116, 118, 120, 122, 124, 126, 128, 296, 298, 300, 483, 498, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, or 1008.

2. The binding molecule of embodiment 1, wherein the first variable region further comprises:
a complementarity determining region 1 (CDR-1) comprising an amino acid sequence set forth in any of SEQ ID NOs: 136, 142, 151, 157, 161, 165, 171, 302, 306, 537, 570, 677, 692, 710, 727, 742, 760, 800, 816, 909, 938, or 1000, or a CDR-1 contained within the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999; and/or a complementarity determining region 2 (CDR-2) comprising an amino acid sequence set forth in any of SEQ ID NOs: 137, 143, 152, 158, 162, 166, 172, 303, 307, 538, 571, 678, 693, 711, 728, 743, 761, 801, 817, 831, 833, 910, 939, or 1001, or a CDR-2 contained within the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999.

3. The binding molecule of embodiment 1 or embodiment 2, wherein the second variable region comprises:
a complementarity determining region 1 (CDR-1) comprising an amino acid sequence set forth in any of SEQ ID NOs: 139, 145, 148, 154, 168, 176, 484, 546, 561, 579, 668, 701, 719, or 751 or a CDR-1 contained within the amino acid sequence set forth in any of SEQ ID NOs: 112, 114, 116, 118, 120, 122, 124, 126, 128, 296, 298, 300, 483, 498, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, or 1008; and/or a complementarity determining region 2 (CDR-2) comprising an amino acid sequence set forth in any of SEQ ID NOs: 140, 149, 155, 169, 177, 485, 547, 562, 580, 669, 702, 720, 752, 918, or 1009, or a CDR-2 contained within the amino acid sequence set forth in any of SEQ ID NOs: 112, 114, 116, 118, 120, 122, 124, 126, 128, 296, 298, 300, 483, 498, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, or 1008.

4. The binding molecule of any of embodiments 1-3, wherein the binding molecule is an antibody or antigen-binding fragment thereof.

5. The binding molecule of any of embodiments 1-3, wherein the binding molecule is a T cell receptor (TCR) or antigen-binding fragment thereof.

6. A T cell receptor (TCR) or antigen-binding fragment thereof, comprising an alpha chain comprising a variable alpha (Vα) region and a beta chain comprising a variable beta (Vβ) region, wherein:
said Vα region comprises the amino acid sequence set forth in any of SEQ ID NOs: 111, 113, 115, 117, 119, 121, 123, 125, 127, 295, 297, 299, 477, 492, 504, 510, 522, 536, 554, 569, 587, 599, 611, 623, 637, 649, 661, 676, 691, 709, 726, 741, 759, 775, 787, 799, 815, 830, 845, 857, 869, 881, 895, 908, 925, 937, 951, 963, 975, 987, or 999, or an amino acid sequence that has at least 90%, 91%, 92%, 93%, 94%, 95%, 96%, 97%, 98%, or 99% sequence identity thereto; and/or said Vβ region comprises the amino acid sequence set forth in any of SEQ ID NOs: 112, 114, 116, 118, 120, 122, 124, 126, 128, 296, 298, 300, 483, 498, 498, 516, 530, 545, 560, 578, 593, 605, 617, 629, 643, 655, 667, 685, 700, 718, 735, 750, 768, 781, 793, 808, 824, 839, 851, 863, 875, 887, 901, 917, 931, 945, 957, 969, 981, 993, or 1008, or an amino acid sequence that has at least 90%, 91%, 92%, 93%, 94%, 95%, 96%, 97%, 98%, or 99% sequence identity thereto.

7. The T cell receptor (TCR) or antigen-binding fragment thereof of embodiment 6, wherein:
said Vα region comprises a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO: 251), wherein $X_1$ is A, I, or V; $X_2$ is M, L, V, E or A; $X_3$ is R, L, N, or S; $X_4$ is E, V, P, T, F, I, R or A; $X_5$ is G, I, L, A, P, R, D, or H; $X_6$ is R, T, G, S, N or H; $X_7$ is G, R, A, N, or null; $X_8$ is T, G, or null; $X_9$ is null, A or G; $X_{10}$ is null or G; $X_{11}$ is null or G; $X_{12}$ is null or T; $X_{13}$ is F, Y, A, S or null; $X_{14}$ is G, Y, or N; $X_{15}$ is F, G, T, N, Q, or Y; $X_{16}$ is K, P, V, N or A; $X_{17}$ is T, L, or F; and $X_{18}$ is I, V, T, H, or N; and/or said Vβ region comprises a complementarity determining region 3 (CDR-3) comprising the amino acid sequence $X_1X_2X_3X_4X_5X_6X_7X_8X_9X_{10}X_{11}X_{12}X_{13}X_{14}X_{15}$ (SEQ ID NO: 261), wherein $X_1$ is A or S; $X_2$ is S, I, or V; $X_3$ is S, T, or V; $X_4$ is H, P, L, Y, T, D, or Q; $X_5$ is L, G, W, F, S, or R; $X_6$ is A, G, L, S, or T; $X_7$ is G, E, A, T, R, or null; $X_8$ is null or G; $X_9$ is null or G; $X_{10}$ is null, F, G, T, S, or A; $X_{11}$ is T, N, H, A, S, or F; $X_{12}$ is G, T, Q, D, Y, or L; $X_{13}$ is E, P, T, G or W; $X_{14}$ is L, A, Q, Y, or K; and $X_{15}$ is F, H, Y, or T.

8. The T cell receptor (TCR) or antigen-binding fragment thereof of embodiment 7, wherein:
said Vα region comprises:
a complementarity determining region 1 (CDR-1) comprising the amino acid sequence $X_1X_2X_3X_4X_5X_6X_7$ (SEQ ID NO: 243), wherein $X_1$ is T, D, N, or V; $X_2$ is I or S; $X_3$ is S, D, A, P, or M; $X_4$ is G, Q, P, or null; $X_5$ is T, S, I, or F; $X_6$ is D, Y, Q, T, or S; and $X_{7\ is}$ Y, G, N, or Q; or
a complementarity determining region 2 (CDR-2) comprising the amino acid sequence $X_1X_2X_3X_4X_5X_6X_7X_8$ (SEQ ID NO: 247), wherein $X_1$ is G, Q, I, V, or M; $X_2$ is L, S, Q, Y, F, T, or G; $X_3$ is T, G, S, or F; $X_4$ is Y, S, N, I, or null; $X_5$ is null or D; $X_6$ is null, E, Q, S, M, or K; $X_7$ is S, Q, R, G, D, or N; and $X_8$ is N, E, M, T, or K; and/or
said Vβ region comprises:
a complementarity determining region 1 (CDR-1) comprising the amino acid sequence $X_1X_2X_3X_4X_5$ (SEQ ID NO: 254), wherein $X_1$ is S, M, or L; $X_2$ is G, E, D, N, or Q; $X_3$ is H or V; $X_4$ is V, N, E, L, or T; and $X_5$ is S, R, N, Y, A, or M; or
a complementarity determining region 2 (CDR-2) comprising the amino acid sequence $X_1X_2X_3X_4X_5X_6X_7$ (SEQ ID NO: 257), wherein $X_1$ is F, Y, S, or A; $X_2$ is Q, Y, V, or N; $X_3$ is N, D, G, F, or Q; $X_4$ is null or G; $X_5$ is E, V, N, K, or S; $X_6$ is A, K, G, or E; and $X_7$ is Q, M, T, I, or A.

9. The binding molecule of any of embodiments 1-5 or TCR or antigen-binding fragment thereof of any of embodiments 6-8, wherein the binding molecule or TCR or antigen-binding fragment thereof binds to or recognizes a peptide epitope of human papillomavirus (HPV) 16 E6 or E7 in the context of an MHC molecule.

10. The binding molecule or TCR or antigen-binding fragment thereof of embodiment 9,
wherein the binding molecule or TCR or antigen-binding fragment thereof binds to or recognizes a peptide epitope of human papillomavirus (HPV) 16 E6 in the context of an MHC molecule.

11. The binding molecule or TCR or antigen-binding fragment thereof of embodiment 10, wherein the peptide epitope derived from HPV16 E6 is or comprises the amino acid sequence set forth in any of SEQ ID NOs: 232-234.

12. The binding molecule or TCR or antigen-binding fragment thereof of embodiment 10 or embodiment 11, wherein the peptide epitope derived from HPV16 E6 is or comprises E6(29-38) TIHDIILECV (SEQ ID NO:233).

13. The binding molecule or TCR or antigen-binding fragment of any of embodiments 1-12, wherein:
said Vα region comprises a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO: 248), wherein $X_1$ is A, I, or V; $X_2$ is M, L, or V; $X_3$ is R, L, or N; $X_4$ is E, V, T, P, or F; $X_5$ is G, I, L, A, or P; $X_6$ is R, T, G, or S; $X_7$ is G, R, or null; $X_8$ is T, G, or null; $X_9$ is null or A; $X_{10}$ is null or G; $X_{11}$ is null or G; $X_{12}$ is null or T; $X_{13}$ is null or S; $X_{14}$ is G, Y, or N; $X_{15}$ is F, G, or T; $X_{16}$ is K or P; $X_{17}$ is T or L; and $X_{18}$ is I, V or T; and/or
said Vβ region comprises a complementarity determining region 3 (CDR-3) comprising the amino acid sequence $ASSX_4X_5X_6X_7X_8X_9X_{10}X_{11}X_{12}X_{13}$ (SEQ ID NO: 258), wherein $X_4$ is H, P, L, or Y; $X_5$ is L, G, W, F, or S; $X_6$ is A, G, or L; $X_7$ is G, E, A, T, or null; $X_8$ is F, G, T, or S; $X_9$ is T, N, H, or A; $X_{10}$ is G, T, Q, D, or Y; $X_{11}$ is E, P, T, or G; $X_{12}$ is L, A, Q, or Y; and $X_{13}$ is F, H, Y, or T.

14. The TCR or antigen-binding fragment thereof of embodiment 13, wherein:
said Vα region comprises: a complementarity determining region 1 (CDR-1) comprising the amino acid sequence $X_1X_2X_3X_4X_5X_6X_7$ (SEQ ID NO: 240), wherein $X_1$ is T, D, or N; $X_2$ is I, or S; $X_3$ is S, D, or A; $X_4$ is G, Q, P, or null; $X_5$ is T, S, or I; $X_6$ is D, Y, or Q; and $X_{7\ is}$ Y, G, N, or Q; or
a complementarity determining region 2 (CDR-2) comprising the amino acid sequence $X_1X_2X_3X_4X_5X_6X_7X_8$(SEQ ID NO: 244), wherein $X_1$ is G, Q, I, or V; $X_2$ is L, S, Q, or Y; $X_3$ is T, G, or S; $X_4$ is Y, S, or null; $X_5$ is null or D; $X_6$ is null, E, Q, or S; $X_{7\ is}$ S, Q, R, or G; and $X_8$ is N or E; and/or
said Vβ region comprises: a complementarity determining region 1 (CDR-1) comprising the amino acid sequence $X_1X_2HX_4X_5$ (SEQ ID NO: 252), wherein $X_1$ is S or M; $X_2$ is G, E, D, or N; $X_4$ is V, N, or E; and $X_5$ is S, R, N, or Y; or a complementarity determining region 2 (CDR-2) comprising the amino acid sequence $X_1X_2X_3X_4X_5X_6$(SEQ ID NO: 255), wherein $X_1$ is F or S; $X_2$ is Q, Y, or V; $X_3$ is N, D, or G; $X_4$ is E or V; $X_5$ is A, K, or G; and $X_6$ is Q, M, or T.

15. The TCR or antigen-binding fragment of any of embodiments 6-14, wherein:
said Vα region comprises a complementarity determining region 3 (CDR-3) comprising an amino acid sequence set forth in any of SEQ ID NOs: 138, 144, 147, 163, 167 173, 304, 308, 478, 493, 505, 511, 523, 539, 555, 572, 588, 600, 612, 624, 638, 650, 662, or 679, or a CDR3 contained within the amino acid sequence set forth in any of SEQ ID NOs: 111, 113, 115, 121, 123 125, 297, 299, 477, 492, 504, 510, 522, 536, 554, 569, 587, 599, 611, 623, 637, 649, 661, or 676; and/or
a Vβ region comprising a complementarity determining region 3 (CDR-3) comprising an amino acid sequence set forth in any of SEQ ID NOs: 141, 146, 150, 164, 170, 174, 305, 309, 486, 499, 517, 531, 548, 563, 581, 594, 606, 618, 630, 644, 656, 670, or 686, or a CDR3 contained within the amino acid sequence set forth in any of SEQ ID NOs: 112, 114, 116, 122, 124 126, 298, 300, 483, 498, 498, 516, 530, 545, 560, 578, 593, 605, 617, 629, 643, 655, 667, or 685.

16. The TCR or antigen-binding fragment of embodiment 15, wherein the Vα region further comprises:

a complementarity determining region 1 (CDR-1) comprising an amino acid sequence set forth in any of SEQ ID NOs: 136, 142, 161, 165, 171, 302, 306, 537, 570, or 677, or a CDR-1 contained within the amino acid sequence set forth in any of SEQ ID NOs: 111, 113, 115, 121, 123, 125, 297, 299, 477, 492, 504, 510, 522, 536, 554, 569, 587, 599, 611, 623, 637, 649, 661, or 676; and/or a complementarity determining region 2 (CDR-2) comprising an amino acid sequence set forth in any of SEQ ID NOs: 137, 143, 162, 166, 172, 303, 307, 538, 571, or 678, or a CDR-2 contained within the amino acid sequence set forth in any of SEQ ID NOs: 111, 113, 115, 121, 123, 125, 297, 299, 477, 492, 504, 510, 522, 536, 554, 569, 587, 599, 611, 623, 637, 649, 661, or 676.

17. The TCR or antigen-binding fragment of embodiment 15 or embodiment 16, wherein the Vβ region comprises:

a complementarity determining region 1 (CDR-1) comprising an amino acid sequence set forth in any of SEQ ID NOs: 139, 145, 148, 168, 484, 546, 561, 579, or 668, or a CDR-1 contained within the amino acid sequence set forth in any of SEQ ID NOs: 112, 114, 116, 122, 124, 126, 298, 300, 483, 498, 516, 530, 545, 560, 578, 593, 605, 617, 629, 643, 655, 667, or 685; and/or a complementarity determining region 2 (CDR-2) comprising an amino acid sequence set forth in any of SEQ ID NOs: 140, 149, 169, 177, 485, 547, 562, 580, or 669, or a CDR-2 contained within the amino acid sequence set forth in any of SEQ ID NOs: 112, 114, 116, 122, 124, 126, 298, 300, 483, 498, 498, 516, 530, 545, 560, 578, 593, 605, 617, 629, 643, 655, 667, or 685.

18. The TCR or antigen-binding fragment thereof of any of embodiments 6-17, wherein:

said Vα region comprises: a complementarity determining region 1 (CDR-1) comprising an amino acid sequence set forth in any of SEQ ID NOs: 136, 142, 161, 165, 171, 302, 306, 537, 570, or 677; a complementarity determining region 2 (CDR-2) comprising an amino acid sequence set forth in any of SEQ ID NOs: 137, 143, 162, 166, 172, 303, 307, 538, 571, or 678; and/or a complementarity determining region 3 (CDR-3) comprising an amino acid sequence set forth in any of SEQ ID NOs: 138, 144, 147, 163, 167, 173, 304, 308, 478, 493, 505, 511, 523, 539, 555, 572, 588, 600, 612, 624, 638, 650, 662, 679; and/or said Vβ region comprises: a complementarity determining region 1 (CDR-1) comprising an amino acid sequence set forth in any of SEQ ID NOs: 139, 145, 148, 168, 484, 546, 561, 579, or 668; a complementarity determining region 2 (CDR-2) comprising an amino acid sequence set forth in any of SEQ ID NOs: 140, 149 or 169; and/or a complementarity determining region 3 (CDR-3) comprising an amino acid sequence set forth in any of SEQ ID NOs: 141, 146, 150, 164, 170, 174, 305, 309, 486, 499, 517, 531, 548, 563, 581, 594, 606, 618, 630, 644, 656, 670, or 686.

19. The TCR or antigen-binding fragment thereof of any of embodiments 6-18, wherein:

said Vα region comprises a CDR-1, CDR-2, and CDR-3, comprising the amino acid sequences of SEQ ID NOs: 136, 137, and 138, respectively, and said Vβ region comprises a CDR-1, CDR-2, and CDR-3, comprising the amino acid sequences of SEQ ID NOs: 139, 140, and 141, respectively;

said Vα region comprises a CDR-1, CDR-2, and CDR-3, comprising the amino acid sequences of SEQ ID NOs: 142, 143, and 144, respectively, and said Vβ region comprises a CDR-1, CDR-2, and CDR-3, comprising the amino acid sequences of SEQ ID NOs: 145, 140, and 146, respectively;

said Vα region comprises a CDR-1, CDR-2, and CDR-3, comprising the amino acid sequences of SEQ ID NOs: 136, 137, and 147, respectively, and said Vβ region comprises a CDR-1, CDR-2, and CDR-3, comprising the amino acid sequences of SEQ ID NOs: 148, 149, and 150, respectively;

said Vα region comprises a CDR-1, CDR-2, and CDR-3, comprising the amino acid sequences of SEQ ID NOs: 161, 162, and 163, respectively, and said Vβ region comprises a CDR-1, CDR-2, and CDR-3, comprising the amino acid sequences of SEQ ID NOs: 148, 149, and 164, respectively;

said Vα region comprises a CDR-1, CDR-2, and CDR-3, comprising the amino acid sequences of SEQ ID NOs: 165, 166, and 167, respectively, and said Vβ region comprises a CDR-1, CDR-2, and CDR-3, comprising the amino acid sequences of SEQ ID NOs: 168, 169, and 170, respectively;

said Vα region comprises a CDR-1, CDR-2, and CDR-3, comprising the amino acid sequences of SEQ ID NOs: 171, 172, and 173, respectively, and said Vβ region comprises a CDR-1, CDR-2, and CDR-3, comprising the amino acid sequences of SEQ ID NOs: 148, 149, and 174, respectively;

said Vα region comprises a CDR-1, CDR-2, and CDR-3, comprising the amino acid sequences of SEQ ID NOs: 302, 303, and 304, respectively, and said Vβ region comprises a CDR-1, CDR-2, and CDR-3, comprising the amino acid sequences of SEQ ID NOs: 139, 140, and 305, respectively; or said Vα region comprises a CDR-1, CDR-2, and CDR-3, comprising the amino acid sequences of SEQ ID NOs: 306, 307, and 308, respectively, and said Vβ region comprises a CDR-1, CDR-2, and CDR-3, comprising the amino acid sequences of SEQ ID NOs: 148, 149, and 309, respectively.

20. The TCR or antigen-binding fragment thereof of any of embodiments 6-19, wherein:

said Vα region comprises a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 111, 113, 115, 121, 123, 125, 297, 299, 477, 492, 504, 510, 522, 536, 554, 569, 587, 599, 611, 623, 637, 649, 661, or 676; and/or said Vβ region comprises a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 112, 114, 116, 122, 124, 126, 298, 300, 483, 498, 498, 516, 530, 545, 560, 578, 593, 605, 617, 629, 643, 655, 667, or 685.

21. The TCR or antigen-binding fragment thereof of any of embodiments 6-20, wherein:

the Vα and Vβ regions comprise the amino acid sequences of SEQ ID NOs: 111 and 112, respectively;

the Vα and Vβ regions comprise the amino acid sequences of SEQ ID NOs: 113 and 114, respectively;

the Vα and Vβ regions comprise the amino acid sequences of SEQ ID NOs: 115 and 116, respectively;

the Vα and Vβ regions comprise the amino acid sequences of SEQ ID NOs: 121 and 122, respectively;

the Vα and Vβ regions comprise the amino acid sequences of SEQ ID NOs: 123 and 124, respectively;

the Vα and Vβ regions comprise the amino acid sequences of SEQ ID NOs: 125 and 126, respectively;

the Vα and Vβ regions comprise the amino acid sequences of SEQ ID NOs: 297 and 298, respectively;

the Vα and Vβ regions comprise the amino acid sequences of SEQ ID NOs: 299 and 300, respectively.

22. The binding molecule or TCR or antigen-binding fragment thereof of embodiment 9, wherein the binding molecule or TCR or antigen-binding fragment thereof binds to or recognizes a peptide epitope of human papillomavirus (HPV) 16 E7 in the context of an MHC molecule.

23. A T cell receptor (TCR) or antigen-binding fragment thereof, comprising an alpha chain comprising a variable alpha (Vα) region and a beta chain comprising a variable beta (Vβ) region, wherein the TCR or antigen-binding fragment thereof binds to or recognizes a peptide epitope of human papillomavirus (HPV) 16 E7 in the context of an MHC molecule.

24. The binding molecule or TCR or antigen-binding fragment thereof of embodiment 22 or embodiment 23, wherein the peptide epitope derived from HPV16 E7 is or comprises the amino acid sequence set forth in any of SEQ ID NOs: 235-239.

25. The binding molecule or TCR or antigen-binding fragment thereof of embodiment 26, wherein the peptide epitope derived from HPV16 E7 is or comprises E7(11-19) YMLDLQPET (SEQ ID NO:236).

26. The TCR or antigen-binding fragment thereof of any of embodiments 5-8 and 22-25, wherein:
said Vα region comprises a complementarity determining region 3 (CDR-3) comprising the amino acid sequence $X_1X_2SX_4X_5X_6X_7X_8X_9X_{10}X_{11}$ (SEQ ID NO: 249), wherein $X_1$ is A or V; $X_2$ is E or V; $X_4$ is I or R; $X_5$ is R or D; $X_6$ is G or N; $X_7$ is F or Y; $X_8$ is N or Q; $X_9$ is V or N; $X_{10}$ is L or F; and $X_{11}$ is H or V; and/or
said Vβ region comprises a complementarity determining region 3 (CDR-3) comprising the amino acid sequence $AX_2TX_4RX_6X_7YX_9X_{10}X_{11}$ (SEQ ID NO: 259), wherein $X_2$ is S or I; $X_4$ is T or D; $X_6$ is S or T; $X_7$ is S or N; $X_9$ is E or G; $X_{10}$ is Q or Y; and $X_{11}$ is Y or T.

27. The TCR or antigen-binding fragment thereof of embodiment 26, wherein:
said Vα region comprises: a complementarity determining region 1 (CDR-1) comprising the amino acid sequence $X_1SX_3X_4X_5X_6$(SEQ ID NO: 241), wherein $X_1$ is D or V; $X_3$ is S, or P; $X_4$ is S or F; $X_5$ is T or S; and $X_{6\ is}$ Y or N; or a complementarity determining region 2 (CDR-2) comprising the amino acid sequence $X_1X_2X_3X_4X_5X_6X_7$ (SEQ ID NO: 245), wherein $X_1$ is I or M; $X_2$ is F or T; $X_3$ is S or F; $X_4$ is N or S; $X_5$ is M or E; $X_6$ is D or N; and $X_7$ is M or T; and/or
said Vβ region comprises: a complementarity determining region 1 (CDR-1) comprising the amino acid sequence set forth in SEQ ID NO: 154; or a complementarity determining region 2 (CDR-2) comprising the amino acid sequence set forth in SEQ ID NO: 155.

28. The TCR or antigen-binding fragment of any of embodiments 5-8 and 22-27, wherein:
said Vα region comprises a complementarity determining region 3 (CDR-3) comprising the amino acid sequence set forth in any of SEQ ID NOs: 153, 159, 301, 694, 712, 729, 744, 762, 776, 788, 802, 818, 832, 846, 858, 870, 882, 896, 911, 926, 940, 952, 964, 976, 988, or 1002, or a CDR3 contained within the amino acid sequence set forth in any of SEQ ID NOs: 117, 119, or 295; and/or
said Vβ region comprises a complementarity determining region 3 (CDR-3) comprising an amino acid sequence set forth in any of SEQ ID NOs: 156, 160, 703, 721, 736, 753, 769, 782, 794, 809, 825, 840, 852, 864, 876, 888, 902, 919, 932, 946, 958, 970, 982, 994, or 1010, or a CDR3 contained within the amino acid sequence set forth in any of SEQ ID NOs: 118, 120, 296, 700, 718, 735, 750, 768, 781, 793, 808, 824, 839, 851, 863, 875, 887, 901, 917, 931, 945, 957, 969, 981, 993, or 1008.

29. The TCR or antigen-binding fragment thereof of embodiment 28, wherein the Vα region further comprises:
a complementarity determining region 1 (CDR-1) comprising an amino acid sequence set forth in any of SEQ ID NOs: 151, 157, 692, 710, 727, 742, 760, 800, 816, 909, 938, or 1000; and/or
a complementarity determining region 2 (CDR-2) comprising an amino acid sequence set forth in any of SEQ ID NOs: 152, 158, 693, 711, 728, 743, 761, 801, 817, 831, 833, 910, 939, or 1001.

30. The TCR or antigen-binding fragment thereof of embodiment 28 or embodiment 29, wherein the Vβ region comprises:
a complementarity determining region 1 (CDR-1) comprising the amino acid sequence set forth in SEQ ID NO: 154; and/or
a complementarity determining region 2 (CDR-2) comprising the amino acid sequence set forth in SEQ ID NO: 155.

31. The TCR or antigen-binding fragment thereof of any of embodiments 5-8 and 22-30, wherein:
said Vα region comprises a CDR-1, CDR-2, and CDR-3, comprising the amino acid sequences of SEQ ID NOs: 151, 152, and 153, respectively, and said Vβ region comprises a CDR-1, CDR-2, and CDR-3, comprising the amino acid sequences of SEQ ID NOs: 154, 155, and 156, respectively;
said Vα region comprises a CDR-1, CDR-2, and CDR-3, comprising the amino acid sequences of SEQ ID NOs: 157, 158, and 159, respectively, and said Vβ region comprises a CDR-1, CDR-2, and CDR-3, comprising the amino acid sequences of SEQ ID NOs: 154, 155, and 160, respectively; or
said Vα region comprises a CDR-1, CDR-2, and CDR-3, comprising the amino acid sequences of SEQ ID NOs: 151, 152, and 301, respectively, and said Vβ region comprises a CDR-1, CDR-2, and CDR-3, comprising the amino acid sequences of SEQ ID NOs: 154, 155, and 156, respectively.

32. The TCR or antigen-binding fragment thereof of any of embodiments 5-8 and 22-31, wherein:
said Vα region comprises a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 117, 119, or 295; and/or
said Vβ region comprises a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 118, 120, 296, 700, 718, 735, 750, 768, 781, 793, 808, 824, 839, 851, 863, 875, 887, 901, 917, 931, 945, 957, 969, 981, 993, or 1008.

33. The TCR or antigen-binding fragment thereof of any of embodiments 5-8 and 22-32, wherein:
the Vα and Vβ regions comprise the amino acid sequences of SEQ ID NOs: 117 and either 118 or 296, respectively;
the Vα and Vβ regions comprise the amino acid sequences of SEQ ID NOs: 119 and 120, respectively; or
the Vα and Vβ regions comprise the amino acid sequences of SEQ ID NOs: 295 and either 118 or 296, respectively.

34. The binding molecule or TCR or antigen-binding fragment thereof of embodiment 22, wherein the peptide epitope derived from HPV16 E7 is or comprises E7(86-93) TLGIVCPI (SEQ ID NO:235).

35. The TCR or antigen-binding fragment thereof of any of embodiments 5-8, 22-24 and 34, wherein:
said Vα region comprises a complementarity determining region 3 (CDR-3) comprising the amino acid sequence set forth in SEQ ID NO: 175; and/or
said Vβ region comprises a complementarity determining region 3 (CDR-3) comprising the amino acid sequence set forth in SEQ ID NO: 178.

36. The TCR or antigen-binding fragment thereof of embodiment 35, wherein the Vα region comprises:
a complementarity determining region 1 (CDR-1) comprising the amino acid sequence set forth in any of SEQ ID NOs: 136 or 142; and/or
a complementarity determining region 2 (CDR-2) comprising the amino acid sequence set forth in any of SEQ ID NOs: 137 or 143.

37. The TCR or antigen-binding fragment thereof of embodiment 35 or embodiment 36, wherein said Vβ region comprises:
a complementarity determining region 1 (CDR-1) comprising an amino acid sequence set forth in SEQ ID NO: 176; and/or
a complementarity determining region 2 (CDR-2) comprising an amino acid sequence set forth in SEQ ID NO: or 177.

38. The TCR or antigen-binding fragment thereof of any of embodiments 5-8, 22-24 and 34-37, wherein:
said Vα region comprises a CDR-1, CDR-2, and CDR-3, comprising the amino acid sequences of SEQ ID NOs: 142, 143, and 175, respectively, and said Vβ region comprises a CDR-1, CDR-2, and CDR-3, comprising the amino acid sequences of SEQ ID NOs: 176, 177, and 178, respectively.

39. The TCR or antigen-binding fragment thereof of any of embodiments 5-8, 22-24 and 34-38, wherein:
said Vα region comprises a complementarity determining region 1 (CDR-1), a CDR-2, and a CDR-3, respectively comprising the CDR-1, CDR-2, and CDR-3 amino acid sequences contained within a Vα region amino acid sequence set forth in SEQ ID NO: 127; and/or
said Vβ region comprises a complementarity determining region 1 (CDR-1), a CDR-2, and a CDR-3, respectively comprising the CDR-1, CDR-2, and CDR-3 amino acid sequences contained within a Vβ region amino acid sequence set forth in SEQ ID NO: 128.

40. The TCR or antigen-binding fragment thereof of any of embodiments 5-8, 22-24 and 34-39, wherein:
the Vα and Vβ regions comprise the amino acid sequences of SEQ ID NOs: 127 and 128, respectively.

41. The TCR or antigen-binding fragment thereof of any of embodiments 5-40, wherein the alpha chain further comprises an alpha constant (Cα) region and/or the beta chain further comprises a beta constant (Cβ) region.

42. The TCR or antigen-binding fragment thereof of embodiment 41, wherein the Cα and Cβ regions are mouse constant regions.

43. The TCR or antigen-binding fragment thereof of embodiment 41 or embodiment 42, wherein:
said Cα region comprises the amino acid sequence set forth in SEQ ID NO: 262, or a sequence of amino acids that has at least 90% sequence identity thereto; and/or
said Cβ region comprises the amino acid sequence set forth in SEQ ID NO: 263, or a sequence of amino acids that has at least 90% sequence identity thereto.

44. The TCR or antigen-binding fragment thereof of embodiment 41, wherein the Cα and Cβ regions are human constant regions.

45. The TCR or antigen-binding fragment thereof of embodiment 41 or embodiment 44, wherein:
said Cα region comprises the amino acid sequence set forth in any of SEQ ID NOs: 212, 213, 215, 217, 218, 220, or 524, or a sequence of amino acids that has at least 90% sequence identity thereto; and/or
said Cβ region comprises the amino acid sequence set forth in any of SEQ ID NOs: 214, 216, 631, or 889, or a sequence of amino acids that has at least 90% sequence identity thereto.

46. The TCR or antigen-binding fragment thereof of any of embodiments 5-45, comprising one or more modifications in the α chain and/or β chain such that when the TCR or antigen-binding fragment thereof is expressed in a cell, the frequency of mispairing between the TCR α chain and β chain and an endogenous TCR α chain and β chain is reduced, the expression of the TCR α chain and β chain is increased and/or the stability of the TCR α chain and β chain is increased.

47. The TCR or antigen-binding fragment thereof of embodiment 46, wherein the one or more modifications is a replacement, deletion, or insertion of one or more amino acids in the Cα region and/or the Cβ region.

48. The TCR or antigen-binding fragment thereof of embodiment 46 or embodiment 47, wherein the one or more modifications comprise replacement(s) to introduce one or more cysteine residues that are capable of forming one or more non-native disulfide bridges between the alpha chain and beta chain.

49. The TCR or antigen-binding fragment thereof of any of embodiments 5-41 and 44-48, comprising a Cα region comprising a cysteine at a position corresponding to position 48 with numbering as set forth in SEQ ID NO: 212, 213, 215, 217, 218, 220, or 524, and/or a Cβ region comprising a cysteine at a position corresponding to position 57 with numbering as set forth in SEQ ID NO: 214, 216, 631, or 889.

50. The TCR or antigen-binding fragment thereof of any of embodiments 41, 44, and 46-49, wherein:
said Cα region comprises the amino acid sequence set forth in any of SEQ ID NOs: 196, 198, 200, 201, 203, or 525, or a sequence of amino acids that has at least 90% sequence identity thereto comprising one or more cysteine residues capable of forming a non-native disulfide bond with the beta chain; and/or
said Cβ region comprises the amino acid sequence set forth in any of SEQ ID NOs: 197, 199, 632, or 890, or a sequence of amino acids that has at least 90% sequence identity thereto that contains one or more cysteine residues capable of forming a non-native disulfide bond with the alpha chain.

51. The TCR or antigen-binding fragment thereof of any of embodiments 5-50, wherein the TCR or antigen-binding fragment thereof is encoded by a nucleotide sequence that has been codon-optimized.

52. The TCR or antigen-binding fragment thereof of any of embodiments 5-21 and 41-45, wherein:
a) said alpha chain comprises:
the amino acid sequence set forth in any of SEQ ID NOs: 18, 28, 38, 68, 78, 88, 287, 291, 473, 488, 500, 506, 518, 532, 550, 565, 583, 595, 607, 619, 633, 645, 657, or 672, a sequence of amino acids that has at least 90% sequence identity thereto; or an amino acid sequence encoded by the nucleotide sequence set forth in any of SEQ ID NOs: 20, 30, 40, 70, 80, 90, 100, 202, 219, 389, 430, 1019, 1021, 1023, 1025, 1027, 1029, 1031, 1033, 1035, 1037, 1039, 1041, 1043, 1045, or a nucleotide sequence that has at least 90% sequence identity thereto; and/or said beta chain comprises an amino acid sequence set forth in any of SEQ ID NOs: 22, 32, 42, 72, 82, 92, 289, 293, 479, 494, 512, 526, 541, 556, 574, 589, 601, 613, 625, 639, 651, 663, or 681, a sequence of amino acids that has at least 90% sequence identity thereto; or an amino acid sequence encoded by the nucleotide sequence set forth in any of SEQ ID NOS: 16, 17, 24, 34, 44, 74, 84, 94, 104, 390, 431, 1020, 1022, 1024, 1026, 1028, 1030, 1032, 1034, 1036, 1038, 1040, 1042, 1044, 1046, or a nucleotide sequence that has at least 90% sequence identity thereto; or b) the alpha and beta chains comprise the amino acid sequences of SEQ ID NOs: 18 and 22, respectively; the alpha and beta chains comprise the amino acid sequences of SEQ ID NOs: 28 and 32, respectively; the alpha and beta chains comprise the amino acid sequences of SEQ ID NOs: 38 and 42, respectively; the alpha and beta chains comprise the amino acid sequences of SEQ ID NOs: 68 and 72, respectively; the alpha and beta chains comprise the amino acid sequences of SEQ ID NOs: 78 and 82, respectively; the alpha and beta chains comprise the amino acid sequences of SEQ ID NOs: 88 and 92, respectively, the alpha and beta chains comprise the amino acid sequences of SEQ ID NOs: 287 and 289, respectively, or the alpha and beta chains comprise the amino acid sequences of SEQ ID NOs: 291 and 293, respectively.

53. The TCR or antigen-binding fragment thereof of any of embodiments 5-21 and 41-51, wherein:

a) said alpha chain comprises:

the amino acid sequence set forth in any of SEQ ID NOs: 19, 29, 39, 69, 89, 288, 292, 474, 489, 501, 507, 519, 533, 551, 566, 584, 596, 608, 620, 634, 646, 658, or 673, a sequence of amino acids that has at least 90% sequence identity thereto that contains one or more cysteine residues capable of forming a non-native disulfide bond with the beta chain; or an amino acid sequence encoded by the nucleotide sequence set forth in any of SEQ ID NOs: 10, 11, 21, 31, 41, 71, 81, 91, 101, 1097, 1099, 1101, 1103, 1105, 1107, 1109, 1111, 1113, 1115, 1117, 1119, 1121, 1123, 1125, 1127, or a nucleotide sequence that has at least 90% sequence identity thereto and encodes an alpha chain that contains one or more cysteine residues capable of forming a non-native disulfide bond with the beta chain; and/or said beta chain comprises an amino acid sequence set forth in any of SEQ ID NOs: 23, 33, 43, 73, 83, 93, 290, 294, 480, 495, 513, 527, 542, 557, 575, 590, 602, 614, 626, 640, 652, 664, or 682, a sequence of amino acids that has at least 90% sequence identity thereto that contains one or more cysteine residues capable of forming a non-native disulfide bond with the alpha chain; or an amino acid sequence encoded by the nucleotide sequence set forth in any of SEQ ID NOs: 7, 8, 25, 35, 45, 75, 85, 95, 105, 1098, 1100, 1102, 1104, 1106, 1108, 1110, 1112, 1114, 1116, 1118, 1120, 1122, 1124, 1126, 1128, or a nucleotide sequence that has at least 90% sequence identity thereto and encodes a beta chain that contains one or more cysteine residues capable of forming a non-native disulfide bond with the alpha chain; or b) the alpha and beta chains comprise the amino acid sequences of SEQ ID NOs: 19 and 23, respectively; the alpha and beta chains comprise the amino acid sequences of SEQ ID NOs: 29 and 33, respectively; the alpha and beta chains comprise the amino acid sequences of SEQ ID NOs: 39 and 43, respectively; the alpha and beta chains comprise the amino acid sequences of SEQ ID NOs: 69 and 73, respectively; the alpha and beta chains comprise the amino acid sequences of SEQ ID NOs: 79 and 83, respectively; the alpha and beta chains comprise the amino acid sequences of SEQ ID NOs: 89 and 93, respectively, the alpha and beta chains comprise the amino acid sequences of SEQ ID NOs: 288 and 290, or the alpha and beta chains comprise the amino acid sequences of SEQ ID NOs: 292 and 294.

54. The TCR or antigen-binding fragment thereof of any of embodiments 5-8, 22-33 and 41-4, wherein:

a) said alpha chain comprises:

the amino acid sequence set forth in SEQ ID NOs: 48, 58, 283, 687, 705, 722, 737, 755, 771, 783, 795, 811, 826, 841, 853, 865, 877, 891, 904, 921, 933, 947, 959, 971, 983, or 995, a sequence of amino acids that has at least 90% sequence identity thereto; or an amino acid sequence encoded by the nucleotide sequence set forth in any of SEQ ID NOs: 50, 60, 183, 1049, 1051, 1055, 1057, 1059, 1061, 1063, 1065, 1067, 1069, 1071, 1073, 1075, 1077, 1079, 1081, 1083, 1085, 1087, 1089, 1091, 1093, 1095, 1225, 1226, or a nucleotide sequence that has at least 90% sequence identity thereto; and/or said beta chain comprises an amino acid sequence set forth in SEQ ID NOs: 52, 62, 285, 696, 714, 731, 746, 764, 777, 789, 804, 820, 835, 847, 859, 871, 883, 897, 913, 927, 941, 953, 965, 977, 989, or 1004, a sequence of amino acids that has at least 90% sequence identity thereto; or an amino acid sequence encoded by the nucleotide sequence set forth in SEQ ID NOS: 54, 64, 108, 1050, 1052, 1056, 1058, 1060, 1062, 1064, 1066, 1068, 1070, 1072, 1074, 1076, 1078, 1080, 1082, 1084, 1086, 1088, 1090, 1092, 1094, 1224, 1227, 1228 or a nucleotide sequence that has at least 90% sequence identity thereto; or b) the alpha and beta chains comprise the amino acid sequences of SEQ ID NOs: 48 and either 52 or 285, respectively; the alpha and beta chains comprise the amino acid sequences of SEQ ID NOs: 58 and 62, respectively; or the alpha and beta chains comprise the amino acid sequences of SEQ ID NOs: 283 and either 52 or 285, respectively.

55. The TCR or antigen-binding fragment thereof of any of embodiments 5-8, 22-33 and 41-51, wherein:

a) said alpha chain comprises:

the amino acid sequence set forth in SEQ ID NOs: 49, 59, 284, 688, 706, 723, 738, 756, 772, 784, 796, 812, 827, 842, 854, 866, 878, 892, 905, 922, 934, 948, 960, 972, 984, or 996, a sequence of amino acids that has at least 90% sequence identity thereto that contains one or more cysteine residues capable of forming a non-native disulfide bond with the beta chain; or an amino acid sequence encoded by the nucleotide sequence set forth in any of SEQ ID NOs: 51, 61, 12, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, or a nucleotide sequence that has at least 90% sequence identity thereto and encodes an alpha chain that contains one or more cysteine residues capable of forming a non-native disulfide bond with the beta chain; and/or said beta chain comprises an amino acid sequence set forth in SEQ ID NOs: 53, 63, 286, 697, 715, 732, 747, 765, 778, 790, 805, 821, 836, 848, 860, 872, 884, 898, 914, 928, 942, 954, 966, 978, 990, or 1005, a sequence of amino acids that has at least 90% sequence identity thereto that contains one or more cysteine residues capable of forming a non-native disulfide bond with the alpha chain; or an amino acid sequence encoded by the nucleotide sequence set forth in SEQ ID NOS: 54, 65, 9, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, or a nucleotide sequence that has at least 90% sequence identity thereto and encodes a beta chain that contains one or more cysteine residues capable of forming a non-native disulfide bond with the alpha chain; or b) the alpha and beta chains comprise the amino acid sequences of SEQ ID NOs: 49 and 53, respectively; the alpha and beta chains comprise the amino acid sequences of SEQ ID NOs: 59 and 63, respectively; or the alpha and beta chains comprise the amino acid sequences of SEQ ID NOs: 284 and 286, respectively.

56. The TCR or antigen-binding fragment thereof of any of embodiments 5-8 and 34-45, wherein:
a) said alpha chain comprises:
the amino acid sequence set forth in SEQ ID NO: 98, a sequence of amino acids that has at least 90% sequence identity thereto; or an amino acid sequence encoded by the nucleotide sequence set forth in SEQ ID NO: 100, or a nucleotide sequence that has at least 90% sequence identity thereto; and/or
said beta chain comprises an amino acid sequence set forth in any of SEQ ID NOs: 9 or 102, a sequence of amino acids that has at least 90% sequence identity thereto; or an amino acid sequence encoded by the nucleotide sequence set forth in any of SEQ ID NOS: 11 or 104, or a nucleotide sequence that has at least 90% sequence identity thereto; or
b) the alpha and beta chains comprise the amino acid sequences of SEQ ID NOs: 98 and 102, respectively.

57. The TCR or antigen-binding fragment thereof of any of embodiments 5-8 and 34-51, wherein:
a) said alpha chain comprises:
the amino acid sequence set forth in SEQ ID NO: 99, a sequence of amino acids that has at least 90% sequence identity thereto that contains one or more cysteine residues capable of forming a non-native disulfide bond with the beta chain; or an amino acid sequence encoded by the nucleotide sequence set forth in SEQ ID NO: 101, or a nucleotide sequence that has at least 90% sequence identity thereto and encodes an alpha chain that contains one or more cysteine residues capable of forming a non-native disulfide bond with the beta chain; and/or
said beta chain comprises an amino acid sequence set forth in any of SEQ ID NOs: 10 or 103, a sequence of amino acids that has at least 90% sequence identity thereto that contains one or more cysteine residues capable of forming a non-native disulfide bond with the alpha chain; or an amino acid sequence encoded by the nucleotide sequence set forth in SEQ ID NO: 105, or a nucleotide sequence that has at least 90% sequence identity thereto and encodes a beta chain that contains one or more cysteine residues capable of forming a non-native disulfide bond with the alpha chain; or
b) the alpha and beta chains comprise the amino acid sequences of SEQ ID NOs: 99 and 103, respectively.

58. The TCR or antigen-binding fragment thereof of any of embodiments 5-57, further comprising a signal peptide.

59. The TCR or antigen-binding fragment thereof of embodiment 58, wherein the signal peptide comprises the amino acid sequence set forth in any of SEQ ID NOs: 181, 184, 187, 189, 190, 192, 193, 310, 311, 182, 185, 186, 188, 191, 194, 487, 540, 549, 564, 573, 582, 671, 680, 695, 704, 713, 730, 745, 754, 763, 770, 803, 810, 819, 834, 903, 912, 920, 1003, or 1011.

60. The binding molecule or TCR or antigen-binding fragment thereof of any of embodiments 1-59, that is isolated or purified or is recombinant.

61. The binding molecule or TCR or antigen-binding fragment thereof of any of embodiments 1-60, that is human.

62. The binding molecule or TCR or antigen-binding fragment thereof of any of embodiments 1-61, that is monoclonal.

63. The binding molecule or TCR or antigen-binding fragment thereof of any of embodiments 1-62, wherein the binding molecule or TCR or antigen-binding fragment thereof is single chain.

64. The binding molecule of or TCR or antigen-binding fragment thereof of any of embodiments 1-62, wherein the binding molecule or TCR or antigen-binding fragment thereof comprises two chains.

65. The binding molecule or TCR or antigen-binding fragment thereof of any of embodiments 1-64, wherein the antigen-specificity is at least partially CD8-independent.

66. The binding molecule or TCR or antigen-binding fragment of any of embodiments 9-65 wherein the MHC molecule is an HLA-A2 molecule.

67. A nucleic acid molecule encoding the binding molecule or the TCR or antigen-binding fragment thereof of any of embodiments 1-66.

68. The nucleic acid molecule of embodiment 67, comprising a nucleotide sequence encoding an alpha chain and/or a nucleotide sequence encoding a beta chain, wherein:
said nucleotide sequence encoding an alpha chain comprises the sequence selected from the group consisting of: residues 61-816 of SEQ ID NO: 20, residues 58-804 of SEQ ID NO: 30, residues 61-825 of SEQ ID NO: 40, residues 64-813 of SEQ ID NO: 50, residues 64-816 of SEQ ID NO: 60, residues 58-807 of SEQ ID NO: 70, residues 61-825 of SEQ ID NO: 80, residues 67-831 of SEQ ID NO: 90, residues 58-801 of SEQ ID NO: 100, residues 64-810 of SEQ ID NO: 183, residues 58-801 of SEQ ID NO: 202, residues 67-813 of SEQ ID NO: 219, or a sequence having at least 90% sequence identity thereto; and/or
said nucleotide sequence encoding a beta chain comprises the sequence selected from the group consisting of: residues 58-930 of SEQ ID NO: 16, residues 58-936 of SEQ ID NO: 17, residues 58-939 of SEQ ID NO: 24, residues 64-930 of SEQ ID NO: 34 or 44, residues 58-933 of SEQ ID NO: 54, residues 58-927 of SEQ ID NO: 64, residues 64-936 of SEQ ID NO: 74, residues 58-933 of SEQ ID NO: 84, residues 63-930 of SEQ ID NO: 94, residues 46-936 of SEQ ID NO: 104, residues 58-933 of SEQ ID NO: 108, or a sequence having at least 90% sequence identity thereto.

69. The nucleic acid molecule of embodiment 67, wherein the nucleotide sequence is codon-optimized.

70. The nucleic acid molecule of embodiment 67 or embodiment 69, comprising a nucleotide sequence encoding an alpha chain and/or a nucleotide sequence encoding a beta chain, wherein:
said nucleotide sequence encoding an alpha chain comprises the sequence selected from the group consisting of: residues 67-825 of SEQ ID NO: 10, residues 58-813 of SEQ ID NO: 11, residues 64-822 of SEQ ID NO: 12 residues 61-825 of SEQ ID NO: 21, residues 58-813 of SEQ ID NO: 31, residues 61-834 of SEQ ID NO: 41, residues 63-822 of SEQ ID NO: 51, residues 64-825 of SEQ ID NO: 61, residues 58-816 of SEQ ID NO: 71, residues 61-834 of SEQ ID NO: 81, residues 67-840 of SEQ ID NO: 91, residues 58-810 of SEQ ID NO: 101, or a sequence having at least 90% sequence identity thereto; and/or said nucleotide sequence encoding a beta chain comprises the sequence selected from the group consisting of: residues 58-930 of SEQ ID NO: 7, residues 58-936 of SEQ ID NO: 8, residues 58-933 of SEQ ID NO: 9 residues 58-939 of SEQ ID NO: 25, residues 64-930 of SEQ ID NO: 35, 45, or 95, residues 58-933 of SEQ ID NO: 54 or 85, residues 58-927 of SEQ ID NO: 65, residues 64-936 of SEQ ID NO: 75, residues 46-936 of SEQ ID NO: 105, or a sequence having at least 90% sequence identity thereto.

71. The nucleic acid molecule of any of embodiments 67-71, wherein the nucleotide sequence encoding the alpha chain and the nucleotide sequence encoding the beta chain are separated by a nucleotide sequence encoding an internal ribosome entry site (IRES) or a peptide sequence that causes ribosome skipping.

72. The nucleic acid molecule of embodiment 71, wherein the nucleotide sequence encoding the alpha chain and the nucleotide sequence encoding the beta chain are separated by a peptide sequence that causes ribosome skipping.

73. The nucleic acid molecule of embodiment 71 or embodiment 742 wherein the peptide that causes ribosome skipping is a P2A or T2A peptide and/or comprises the sequence of amino acids set forth in SEQ ID NO: 204 or 211.

74. The nucleic acid of any of embodiments 67-73, comprising the nucleotide sequence set forth in any of SEQ ID NOs: 13, 14, 15, 26, 36, 46, 56, 66, 76, 86, 96, 106, 432-472, or a nucleotide sequence having at least 90% sequence identity thereto.

75. The nucleic acid of any of embodiments 67-74, wherein the nucleic acid is synthetic.

76. The nucleic acid of any of embodiments 67-75, wherein the nucleic acid is cDNA.

77. A vector comprising the nucleic acid of any of embodiments 67-76.

78. The vector of embodiment 77, wherein the vector is an expression vector.

79. The vector of embodiment 77 or embodiment 78, wherein the vector is a viral vector.

80. The vector of embodiment 79, wherein the viral vector is a retroviral vector.

81. The vector of embodiment 79 or embodiment 80, wherein the viral vector is a lentiviral vector.

82. The vector of embodiment 81, wherein the lentiviral vector is derived from HIV-1.

83. An engineered cell comprising the vector of any of embodiments 77-82.

84. An engineered cell, comprising the binding molecule or the TCR or antigen-binding fragment thereof of any of embodiments 1-66.

85. The engineered cell of embodiment 83 or embodiment 84, wherein the binding molecule or TCR or antigen-binding fragment thereof is heterologous to the cell.

86. An engineered cell, comprising a heterologous TCR or antigen-binding fragment thereof that binds to or recognizes a peptide epitope of human papillomavirus (HPV) 16 E6 in the context of an MHC molecule, wherein the TCR or antigen-binding fragment thereof does not bind to or recognize the epitope E6(29-38) comprising the amino acid sequence TIHDIILECV (SEQ ID NO. 233).

87. The engineered cell of embodiment 86, wherein the TCR or antigen-binding fragment thereof that binds to or recognizes a peptide epitope of human papillomavirus (HPV) 16 E6 in the context of an MHC molecule is or comprises the sequence set forth in SEQ ID NO: 232 or SEQ ID NO: 234.

88. An engineered cell, comprising a heterologous TCR or antigen-binding fragment thereof that binds to or recognizes a peptide epitope of human papillomavirus (HPV) 16 E7 in the context of an MHC molecule.

89. The engineered cell of embodiment 88, wherein the peptide derived from HPV16 E7 is or comprises the sequence set forth in any of SEQ ID NOs: 235-239.

90. The engineered cell of embodiment 88 or embodiment 89, wherein the peptide derived from HPV16 E7 is or comprises the sequence set forth in SEQ ID NO: 236.

91. The engineered cell of any of embodiments 88-90, wherein the TCR or antigen-binding fragment thereof is a TCR or antigen-binding fragment thereof of any of embodiments 25-33, 55 or 56.

92. The engineered cell of embodiment 88 or embodiment 89, wherein the peptide derived from HPV16 E7 is or comprises the sequence set forth in SEQ ID NO: 235.

93. The engineered cell of embodiment 88, 89 or 92, wherein the TCR or antigen-binding fragment thereof is a TCR or antigen-binding fragment thereof of any of embodiments 34-42, 58 or 59.

94. The engineered cell of any of embodiments 83-93, wherein the engineered cell is a T cell.

95. The engineered cell of embodiment 94, wherein the T cell is CD8+.

96. The engineered cell of embodiment 94, wherein the T cell is CD4+.

97. A method for producing a cell of any of embodiments 83-96, comprising transducing a cell in vitro or ex vivo with a vector according to any of embodiments 77-82.

98. A composition, comprising the binding molecule or the TCR or antigen-binding fragment thereof of any of embodiments 1-66, or the engineered cell of any of embodiments 83-96.

99. A composition, comprising an engineered CD8+ cell of embodiment 95 and an engineered CD4+ cell of embodiment 96.

100. The composition of embodiment 99, wherein the TCR or antigen-binding fragment thereof binds to or recognizes a peptide epitope of HPV 16 in the context of an MHC molecule that is at least partially CD8-independent.

101. The composition of embodiment 99 or embodiment 100, wherein the CD8+ cell and CD4+ cell are engineered with the same TCR or antigen-binding fragment thereof and/or are each engineered with a TCR or antigen-binding fragment thereof that binds to or recognizes the same peptide epitope of HPV 16 in the context of an MHC molecule.

102. The composition of any of embodiments 99-101, further comprising a pharmaceutically acceptable excipient.

103. A method of treatment, comprising administering the engineered cell of any of embodiments 83-96 to a subject having a disease or disorder associated with HPV.

104. A method of treatment, comprising administering the composition of any of embodiments 98-102 to a subject having a disease or disorder associated with HPV.

105. The method of embodiment 103 or embodiment 104, wherein the disease or disorder is associated with HPV16.

106. The method of any of embodiments 103-105, wherein the disease or disorder is cancer.

107. A T cell receptor (TCR) or antigen-binding fragment thereof, comprising an alpha chain comprising a variable alpha (Vα) region and a beta chain comprising a variable beta (Vβ) region, wherein:

the Vα region comprises the amino acid sequence set forth in any of SEQ ID NOs: 117, 119 or 295 or an amino acid sequence that has at least 90%, 91%, 92%, 93%, 94%, 95%, 96%, 97%, 98%, or 99% sequence identity thereto; and/or the Vβ region comprises the amino acid sequence set forth in any of SEQ ID NOs: 118, 120, or 296, or an amino acid sequence that has at least 90%, 91%, 92%, 93%, 94%, 95%, 96%, 97%, 98%, or 99% sequence identity thereto.

108. The TCR or antigen-binding fragment thereof of any of embodiment 107, wherein:

the Vα region comprises a complementarity determining region 3 (CDR-3) comprising the amino acid sequence $X_1X_2X_3X_4X_5X_6X_7X_8X_9X_{10}X_{11}X_{12}X_{13}X_{14}$ (SEQ ID NO: 1183), wherein $X_1$ is A or V; $X_2$ is V, A, G, Q, M, or E; $X_3$ is S, G, A, N, Y, R, T, or P; $X_4$ is E, A, S, G, R, F, N, D, V, P, L, I, or M; $X_5$ is R, N, H, T, D, G, S, A, P, L, Q, or F; $X_6$ is G, H, N, A, S, L, or T; $X_7$ is T, S, G, or null; $X_8$ is G, or null; $X_9$ is G, Y, N, S, or null; $X_{10}$ is T, G, S, D, F, Y, A, N, or null; $X_{11}$ is Y, F, Y, Q, N, or R; $X_{12}$ is N, K, Q, or D; $X_{13}$ is Y, L, T, F, M, or V; and $X_{14}$ is I, T, S, V, R, or Y; and/or the Vβ region comprises a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO: 1193), wherein $X_2$ is 5, M, I, K, or V; $X_3$ is S, T, N, or A; $X_4$ is R, V, P, S, T, G, L, A, I, or D; $X_5$ is F, G, R, Y, S, L, V, or T; $X_6$ is L, G, D, A, S, T, V, R, or null; $X_7$ is G, D, R, S, T, or null; $X_8$ is S, or null; $X_9$ is S, H, G, R, V, T, D, L, or null; $X_{10}$ is T, S, A, Y, N, G, or P; $X_{11}$ is D, Y, N, E, K, or G; $X_{12}$ is T, E, G, or K; $X_{13}$ is Q, Y, A, or L; and $X_{14}$ is Y, F, T, or I.

109. A T cell receptor (TCR) or antigen-binding fragment thereof, comprising an alpha chain comprising a variable alpha (Vα) region and a beta chain comprising a variable beta (Vβ) region, wherein:

the Vα region comprises a complementarity determining region 3 (CDR-3) comprising the amino acid sequence $X_1X_2X_3X_4X_5X_6X_7X_8X_9X_{10}X_{11}X_{12}X_{13}X_{14}$ (SEQ ID NO: 1183), wherein $X_1$ is A or V; $X_2$ is V, A, G, Q, M, or E; $X_3$ is S, G, A, N, Y, R, T, or P; $X_4$ is E, A, S, G, R, F, N, D, V, P, L, I, or M; $X_5$ is R, N, H, T, D, G, S, A, P, L, Q, or F; $X_6$ is G, H, N, A, S, L, or T; $X_7$ is T, S, G, or null; $X_8$ is G, or null; $X_9$ is G, Y, N, S, or null; $X_{10}$ is T, G, S, D, F, Y, A, N, or null; $X_{11}$ is Y, F, Y, Q, N, or R; $X_{12}$ is N, K, Q, or D; $X_{13}$ is Y, L, T, F, M, or V; and $X_{14}$ is I, T, S, V, R, or Y; and/or the Vβ region comprises a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO: 1193), wherein $X_2$ is 5, M, I, K, or V; $X_3$ is S, T, N, or A; $X_4$ is R, V, P, S, T, G, L, A, I, or D; $X_5$ is F, G, R, Y, S, L, V, or T; $X_6$ is L, G, D, A, S, T, V, R, or null; $X_7$ is G, D, R, S, T, or null; $X_8$ is S, null; $X_9$ is S, H, G, R, V, T, D, L, or null; $X_{10}$ is T, S, A, Y, N, G, or P; $X_{11}$ is D, Y, N, E, K, or G; $X_{12}$ is T, E, G, or K; $X_{13}$ is Q, Y, A, or L; and $X_{14}$ is Y, F, T, or I.

110. The TCR or antigen-binding fragment thereof of embodiment 108 or embodiment 109, wherein the Vα region comprises a complementarity determining region 3 (CDR-3) comprising the amino acid sequence $VVX_3X_4X_5X_6X_7X_8GX_{10}X_{11}X_{12}X_{13}$ (SEQ ID NO:1184), wherein $X_3$ is S, N, or T; $X_4$ is R, or F; $X_5$ is D, or A; $X_6$ is N, or L; $X_7$ is T, or null; $X_8$ is Y, or G; $X_{10}$ is Q, or F; $X_{11}$ is N, or K; $X_{12}$ is F, or T; and $X_{13}$ is V, or I.

111. The TCR or antigen-binding fragment thereof of any of embodiments 108-110, wherein:

the Vβ region comprises a complementarity determining region 3 (CDR-3) comprising the amino acid sequence $AX_2TX_4X_5X_6X_7X_8X_9X_{10}X_{11}X_{12}$ (SEQ ID NO:1194), wherein $X_2$ is 5, M, I, or K; $X_4$ is P, T, G, A, S, or D; $X_5$ is R, or S; $X_6$ is D, G, S, T, or V; $X_7$ is R, S, or null; $X_8$ is T, Y, G, N, or S; $X_9$ is Y, N, or K; $X_{10}$ is E, or G; $X_{11}$ is Q, A, or Y; and $X_{12}$ is Y, F, or T;

the Vβ region comprises a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO: 1195), wherein $X_2$ is 5, M, I, or K; $X_3$ is S, T, A, or N; $X_4$ is R, V, S, P, T, G, L, or A; $X_5$ is F, G, R, Y, S, V, or T; $X_6$ is L, G, D, A, S, T, V, or null; $X_7$ is G, D, R, T, or null; $X_8$ is S, or null; $X_9$ is S, H, G, R, V, T, L, or null; $X_{10}$ is T, S, Y, A, N, G, or P; $X_{11}$ is D, Y, N, K, E, or G; $X_{12}$ is T, or E; $X_{13}$ is Q, A, or L; and $X_{14}$ is Y, or F;

the Vβ region comprises a complementarity determining region 3 (CDR-3) comprising the amino acid sequence $AX_2X_3X_4X_5X_6X_7X_8X_9X_{10}X_{11}$ Q Y (SEQ ID NO: 1196), wherein $X_2$ is 5, M, I, or K; $X_3$ is S, T, A, or N; $X_4$ is R, P, S, G, L, A, or T; $X_5$ is F, R, Y, V, or T; $X_6$ is L, D, A, S, T, V, or null; $X_7$ is G, R, or null; $X_8$ is S, G, V, or null; $X_9$ is T, A, G, N, S, or P; $X_{10}$ is D, Y, or E; and $X_{11}$ is T, or E;

the Vβ region comprises a complementarity determining region 3 (CDR-3) comprising the amino acid sequence $AX_2X_3X_4X_5X_6X_7X_8X_9YEQY$ (SEQ ID NO: 1197), wherein $X_2$ is 5, M, I, or K; $X_3$ is S, T, A, or N; $X_4$ is P, S, G, T, or A; $X_5$ is R, or Y; $X_6$ is D, A, S, T, or V; $X_7$ is R, or null; $X_8$ is G, V, or null; and $X_9$ is S, T, A, or N;

the Vβ region comprises a complementarity determining region 3 (CDR-3) comprising the amino acid sequence $ASTX_4X_5X_6X_7X_8X_9X_{10}X_{11}EX_{13}X_{14}$ (SEQ ID NO:1198), wherein $X_4$ is T, P, or G; $X_5$ is R, or S; $X_6$ is S, D, G, or V; $X_7$ is D, or null; $X_8$ is S, or null; $X_9$ is S, R, or null; $X_{10}$ is S, T, Y, or G; $X_{11}$ is Y, N, or K; $X_{13}$ is Q, or A; and $X_{14}$ is Y, or F;

the Vβ region comprises a complementarity determining region 3 (CDR-3) comprising the amino acid sequence $AX_2X_3X_4X_5X_6X_7X_8YGYT$ (SEQ ID NO: 1199), wherein $X_2$ is S, or I; $X_3$ is S, or T; $X_4$ is L, A, or D; $X_5$ is L, T, or R; $X_6$ is L, T, or R; $X_7$ is G, D, or null; and $X_8$ is A, or N; or the Vβ region comprises a complementarity determining region 3 (CDR-3) comprising the amino acid sequence $AX_2TX_4RX_6X_7YX_9X_{10}X_{11}$ (SEQ ID NO: 259), wherein $X_2$ is S or I; $X_4$ is T or D; $X_6$ is S or T; $X_7$ is S or N; $X_9$ is E or G; $X_{10}$ is Q or Y; and $X_{11}$ is Y or T.

112. The TCR or antigen-binding fragment thereof of any of embodiments 107-111 wherein the Vα region comprises:

a complementarity determining region 1 (CDR-1) comprising the amino acid sequence $X_1X_2X_3X_4X_5X_6$ (SEQ ID NO: 1191), wherein $X_1$ is N, S, D, T, or V; $X_2$ is 5, V, R, T, or I; $X_3$ is M, F, G, S, N, A, L, V, or P; $X_4$ is F, S, N, A, or null; $X_5$ is D, S, Q, Y, N, V, T, or P; and $X_6$ is Y, S, R, N, G, or T; and/or a complementarity determining region 2 (CDR-2) comprising the amino acid sequence $X_1X_2X_3X_4X_5X_6X_7X_8$ (SEQ ID NO: 1192), wherein $X_1$ is I, V, L, G, N, T, Y, or M; $X_2$ is 5, V, Y, L, P, F, I, or T; $X_3$ is S, Y, K, L, T, or F; $X_4$ is I, G, N, A, S, or null; $X_5$ is S, D, or null; $X_6$ is K, G, N, S, D, T, or E; $X_7$ is D, E, G, A, K, L, or N; and $X_8$ is K, V, D, P, N, T, L, or M.

113. The TCR or antigen-binding fragment thereof of any of embodiments 107-112, wherein the Vβ region comprises:

a complementarity determining region 1 (CDR-1) comprising the amino acid sequence $SX_2X_3X_4X_5$ (SEQ ID NO:1203), wherein $X_2$ is G, or N; $X_3$ is H, or D; $X_4$ is T, L, N, or V; $X_5$ is A, S, Y, or T; and/or a complementarity determining region 2 (CDR-2) comprising the amino acid sequence $X_1X_2X_3X_4X_5X_6$, wherein $X_1$ is F, or Y; $X_2$ is Q, Y, or N; $X_3$ is G, N, R, or Y; $X_4$ is N, G, E, or T; $X_5$ is S, E, A, or G; and $X_6$ is A, E, I, or Q.

114. The TCR or antigen-binding fragment thereof of any of embodiments 107-113, wherein:

the Vα region comprises: a complementarity determining region 1 (CDR-1) comprising the amino acid sequence $X_1SX_3X_4X_5X_6$ (SEQ ID NO: 241), wherein $X_1$ is D or V; $X_3$ is S, or P; $X_4$ is S or F; $X_5$ is T or S; and $X_6$ is Y or N; or a complementarity determining region 2 (CDR-2) comprising the amino acid sequence $X_1X_2X_3X_4X_5X_6X_7$ (SEQ ID NO: 245), wherein $X_1$ is I or M; $X_2$ is F or T; $X_3$ is S or F; $X_4$ is N or S; $X_5$ is M or E; $X_6$ is D or N; and $X_7$ is M or T; and/or the Vβ region comprises: a complementarity determining region 1 (CDR-1) comprising the amino acid sequence set forth in SEQ ID NO: 154; or a complementarity determining region 2 (CDR-2) comprising the amino acid sequence set forth in SEQ ID NO: 155.

115. The TCR or antigen-binding fragment thereof of any of embodiments 107-114, wherein the TCR or antigen-binding fragment thereof binds to or recognizes a peptide epitope of human papillomavirus (HPV) 16 E7 in the context of an MHC molecule, the peptide epitope is or comprises E7(11-19) YMLDLQPET (SEQ ID NO:236).

116. The TCR or antigen-binding fragment of any of embodiments 107-115, wherein:

the Vα region comprises a complementarity determining region 3 (CDR-3) comprising the amino acid sequence set forth in any of SEQ ID NOs: 153, 159, or 301, or a CDR3 contained within the amino acid sequence set forth in any of SEQ ID NOs: 117, 119, or 295; and/or the Vβ region comprises a complementarity determining region 3 (CDR-3) comprising an amino acid sequence set forth in any of SEQ ID NOs: 156 or 160 or a CDR3 contained within the amino acid sequence set forth in any of SEQ ID NOs: 118, 120, or 296.

117. The TCR or antigen-binding fragment thereof of any of embodiments 107-116, wherein the Vα region further comprises:

a complementarity determining region 1 (CDR-1) comprising an amino acid sequence set forth in any of SEQ ID NOs: 151 or 157; and/or a complementarity determining region 2 (CDR-2) comprising an amino acid sequence set forth in any of SEQ ID NOs: 152 or 158.

118. The TCR or antigen-binding fragment thereof of any of embodiments 107-117, wherein the Vβ region comprises:

a complementarity determining region 1 (CDR-1) comprising the amino acid sequence set forth in SEQ ID NO: 154; and/or a complementarity determining region 2 (CDR-2) comprising the amino acid sequence set forth in SEQ ID NO: 155.

119. The TCR or antigen-binding fragment thereof of any of embodiments 107-118, wherein:

the Vα region comprises a CDR-1, CDR-2, and CDR-3, comprising the amino acid sequences of SEQ ID NOs: 151, 152, and 153, respectively, and the Vβ region comprises a CDR-1, CDR-2, and CDR-3, comprising the amino acid sequences of SEQ ID NOs: 154, 155, and 156, respectively;

the Vα region comprises a CDR-1, CDR-2, and CDR-3, comprising the amino acid sequences of SEQ ID NOs: 157, 158, and 159, respectively, and the Vβ region comprises a CDR-1, CDR-2, and CDR-3, comprising the amino acid sequences of SEQ ID NOs: 154, 155, and 160, respectively; or the Vα region comprises a CDR-1, CDR-2, and CDR-3, comprising the amino acid sequences of SEQ ID NOs: 151, 152, and 301, respectively, and the Vβ region comprises a CDR-1, CDR-2, and CDR-3, comprising the amino acid sequences of SEQ ID NOs: 154, 155, and 156, respectively.

120. The TCR or antigen-binding fragment thereof of any of embodiments 107-119, wherein:

the Vα region comprises a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 117, 119, or 295; and/or the Vβ region comprises a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 118, 120, or 296.

121. The TCR or antigen-binding fragment thereof of any of embodiments 107-120, wherein:

the Vα and Vβ regions comprise the amino acid sequences of SEQ ID NOs: 117 and either 118 or 296, respectively;

the Vα and Vβ regions comprise the amino acid sequences of SEQ ID NOs: 119 and 120, respectively; or the Vα and Vβ regions comprise the amino acid sequences of SEQ ID NOs: 295 and either 118 or 296, respectively.

122. The TCR or antigen-binding fragment thereof of any of embodiments 107-121, wherein the alpha chain further comprises an alpha constant (Cα) region and/or the beta chain further comprises a beta constant (Cβ) region.

123. The TCR or antigen-binding fragment thereof of embodiment 122, wherein the Cα and Cβ regions are mouse constant regions.

124. The TCR or antigen-binding fragment thereof of embodiment 122 or embodiment 123, wherein:

the Cα region comprises the amino acid sequence set forth in SEQ ID NO: 262, 833, 1012, 1014, 1015, 1017, 1018, or a sequence of amino acids that has at least 90% sequence identity thereto; and/or the Cβ region comprises the amino acid sequence set forth in SEQ ID NO: 263, 1013 or 1016 or a sequence of amino acids that has at least 90% sequence identity thereto.

125. The TCR or antigen-binding fragment thereof of embodiment 122, wherein the Cα and Cβ regions are human constant regions.

126. The TCR or antigen-binding fragment thereof of embodiment 122 or embodiment 19, wherein:

the Cα region comprises the amino acid sequence set forth in any of SEQ ID NOs: 212, 213, 215, 217, 218, 220 or 524, or a sequence of amino acids that has at least 90% sequence identity thereto; and/or the Cβ region comprises the amino acid sequence set forth in any of SEQ ID NOs: 214, 216, 631 or 889, or a sequence of amino acids that has at least 90% sequence identity thereto.

127. The TCR or antigen-binding fragment thereof of any of embodiments 107-126, wherein:

a) the alpha chain comprises:
the amino acid sequence set forth in SEQ ID NOs: 48, 58, or 283, a sequence of amino acids that has at least 90% sequence identity thereto; or the amino acid sequence encoded by the nucleotide sequence set forth in any of SEQ ID NOs: 50. 60, 183, 1093 or 1095 or a nucleotide sequence that has at least 90% sequence identity thereto; and/or the beta chain comprises:

the amino acid sequence set forth in SEQ ID NOs: 52, 62, or 285, a sequence of amino acids that has at least 90% sequence identity thereto; or the amino acid sequence encoded by the nucleotide sequence set forth in SEQ ID NOS: 55, 64, 108, or 1094, or a nucleotide sequence that has at least 90% sequence identity thereto; or b) the alpha and beta chains comprise the amino acid sequences of SEQ ID NOs: 48 and either 52 or 285, respectively; the alpha and beta chains comprise the amino acid sequences of SEQ ID NOs: 58 and 62, respectively; or the alpha and beta chains comprise the amino acid sequences of SEQ ID NOs: 283 and either 52 or 285, respectively.

128. The TCR or antigen-binding fragment thereof of any of embodiments 107-125, wherein the TCR or antigen-binding fragment comprises one or more modifications in the α chain and/or β chain such that when the TCR or antigen-binding fragment thereof is expressed in a cell, the frequency of mispairing between the TCR α chain and β chain and an endogenous TCR α chain and β chain is reduced, the expression of the TCR α chain and β chain is increased and/or the stability of the TCR α chain and β chain is increased, each compared to expression in a cell of the TCR or antigen-binding fragment thereof not containing the one or more modifications.

129. The TCR or antigen-binding fragment thereof of embodiment 128, wherein the one or more modifications is a replacement, deletion, or insertion of one or more amino acids in the Cα region and/or the Cβ region.

130. The TCR or antigen-binding fragment thereof of embodiment 128 or embodiment 129, wherein the one or more modifications comprise replacement(s) to introduce one or more cysteine residues that are capable of forming one or more non-native disulfide bridges between the alpha chain and beta chain.

131. The TCR or antigen-binding fragment thereof of any of embodiments 107-122, 125 and 128-130, comprising a Cα region comprising a cysteine at a position corresponding to position 48 with numbering as set forth in SEQ ID NO: 212, 213, 217, 218, or 524 or at a position corresponding to position 49 with numbering as set forth in SEQ ID NO: 215 or 220; and/or a Cβ region comprising a cysteine at a position corresponding to position 57 with numbering as set forth in SEQ ID NO: 214 or 216 or at a position corresponding to position 58 with numbering as set forth in SEQ ID NO: 631 or 889.

132. The TCR or antigen-binding fragment thereof of any of embodiments 122, 125, and 128-130, wherein:

the Cα region comprises the amino acid sequence set forth in any of SEQ ID NOs: 196, 198, 200, 201, 203, or 525, or a sequence of amino acids that has at least 90% sequence identity thereto comprising one or more cysteine residues capable of forming a non-native disulfide bond with the beta chain; and/or the Cβ region comprises the amino acid sequence set forth in any of SEQ ID NOs: 197, 199, 632, or 890 or a sequence of amino acids that has at least 90% sequence identity thereto that contains one or more cysteine residues capable of forming a non-native disulfide bond with the alpha chain.

133. The TCR or antigen-binding fragment thereof of any of embodiments 107-132, wherein the TCR or antigen-binding fragment thereof is encoded by a nucleotide sequence that has been codon-optimized.

134. The TCR or antigen-binding fragment thereof of any of embodiments 107-132, wherein:

a) the alpha chain comprises:

the amino acid sequence set forth in SEQ ID NOs: 49, 59, or 284, a sequence of amino acids that has at least 90% sequence identity thereto that contains one or more cysteine residues capable of forming a non-native disulfide bond with the beta chain; or an amino acid sequence encoded by the nucleotide sequence set forth in any of SEQ ID NOs: 51, 61, 12, 1175 or 1177 or a nucleotide sequence that has at least 90% sequence identity thereto and encodes an alpha chain that contains one or more cysteine residues capable of forming a non-native disulfide bond with the beta chain; and/or the beta chain comprises:

the amino acid sequence set forth in SEQ ID NOs: 53, 63, or 286, a sequence of amino acids that has at least 90% sequence identity thereto that contains one or more cysteine residues capable of forming a non-native disulfide bond with the alpha chain; or an amino acid sequence encoded by the nucleotide sequence set forth in SEQ ID NOS: 54, 65, 9, 1176 or 1178 or a nucleotide sequence that has at least 90% sequence identity thereto and encodes a beta chain that contains one or more cysteine residues capable of forming a non-native disulfide bond with the alpha chain; or b) the alpha and beta chains comprise the amino acid sequences of SEQ ID NOs: 49 and 53, respectively; the alpha and beta chains comprise the amino acid sequences of SEQ ID NOs: 59 and 63, respectively; or the alpha and beta chains comprise the amino acid sequences of SEQ ID NOs: 284 and 286, respectively.

135. The TCR or antigen-binding fragment thereof of any of embodiments 107-134, wherein the alpha and/or beta chain further comprises a signal peptide.

136. The TCR or antigen-binding fragment thereof of embodiment 135, wherein:

the alpha chain comprises the signal peptide comprising the amino acid sequence set forth in any of SEQ ID NOs: 181, 184, 187, 189, 190, 192, 193, 310, 311; and/or the beta chain comprises the signal peptide comprising the amino acid sequence set forth in any of SEQ ID NOs: 182, 185, 186, 188, 191, or 194.

137. The TCR or antigen-binding fragment thereof of any of embodiments 107-136, that is isolated or purified or is recombinant.

138. The TCR or antigen-binding fragment thereof of any of embodiments 107-137, that is human.

139. The TCR or antigen-binding fragment thereof of any of embodiments 107-138, that is monoclonal.

140. The TCR or antigen-binding fragment thereof of any of embodiments 107-139, wherein the TCR or antigen-binding fragment thereof is single chain.

141. The TCR or antigen-binding fragment thereof of any of embodiments 107-139, wherein the TCR or antigen-binding fragment thereof comprises two chains.

142. The TCR or antigen-binding fragment thereof of any of embodiments 107-141, wherein the antigen-specificity is at least partially CD8-independent.

143. The TCR or antigen-binding fragment of any of embodiments 115-142 wherein the MHC molecule is an HLA-A2 molecule.

144. A nucleic acid molecule encoding the TCR or antigen-binding fragment thereof of any of embodiments 107-143, or an alpha or beta chain thereof.

145. The nucleic acid molecule of embodiment 144, comprising a nucleotide sequence encoding an alpha chain and/or a nucleotide sequence encoding a beta chain, wherein:

the nucleotide sequence encoding an alpha chain comprises residues 64-813 of SEQ ID NO: 50, residues 64-816 of SEQ ID NO: 60, or residues 64-810 of SEQ ID NO: 183, or a sequence having at least 90% sequence identity thereto; or comprises the sequence set forth in any of SEQ ID NOS: 50, 60, 183, 1093 or 1095, or a sequence having at least 90% sequence identity thereto; and/or the nucleotide sequence encoding a beta chain comprises residues 58-933 of SEQ ID NO: 55, residues 58-927 of SEQ ID NO: 64, residues 58-933 of SEQ ID NO: 108, or a sequence having at least 90% sequence identity thereto, or comprises the sequence set forth in any of SEQ ID NOS: 55, 64, 108 or 1094 or a sequence having at least 90% sequence identity thereto.

146. The nucleic acid molecule of embodiment 144, wherein the nucleotide sequence is codon-optimized.

147. The nucleic acid molecule of embodiment 144 or embodiment 146, comprising a nucleotide sequence encoding an alpha chain and/or a nucleotide sequence encoding a beta chain, wherein:

the nucleotide sequence encoding an alpha chain comprises residues 64-822 of SEQ ID NO: 12, residues 63-822 of SEQ ID NO: 51, residues 64-825 of SEQ ID NO: 61, or a sequence having at least 90% sequence identity thereto, or comprises the sequence set forth in any of SEQ ID NOS: 12, 51, 61, 1175, or 1177, or a sequence having at least 90% sequence identity thereto; and/or the nucleotide sequence encoding a beta chain comprises residues 58-933 of SEQ ID NO: 9; residues 58-933 of SEQ ID NO: 54, residues 58-927 of SEQ ID NO: 65, or a sequence having at least 90% sequence identity thereto, or comprises the sequence set forth in any of SEQ ID NOS: 9, 54, 65, 1176 or 1178, or a sequence having at least 90% sequence identity thereto.

148. The nucleic acid molecule of any of embodiments 144-147, wherein the nucleotide sequence encoding the alpha chain and the nucleotide sequence encoding the beta chain are separated by a peptide sequence that causes ribosome skipping.

149. The nucleic acid molecule of embodiment 148, wherein the peptide that causes ribosome skipping is a P2A or T2A peptide and/or comprises the sequence of amino acids set forth in SEQ ID NO: 204 or 211.

150. The nucleic acid of any of embodiments 144-149, comprising the nucleotide sequence set forth in any of SEQ ID NOs: 15, 56, 66, 471 or 472 or a nucleotide sequence having at least 90% sequence identity thereto.

151. A T cell receptor (TCR) or antigen-binding fragment thereof, comprising an alpha chain comprising a variable alpha (Vα) region and a beta chain comprising a variable beta (Vβ) region, wherein:

the Vα region comprises the amino acid sequence set forth in any of SEQ ID NOs: 111, 113, 115, 121, 123, 125, 297, or 299 or an amino acid sequence that has at least 90%, 91%, 92%, 93%, 94%, 95%, 96%, 97%, 98%, or 99% sequence identity thereto; and/or the Vβ region comprises the amino acid sequence set forth in any of SEQ ID NOs: SEQ ID NOs: 112, 114, 116, 122, 124, 126, 298, or 300, or an amino acid sequence that has at least 90%, 91%, 92%, 93%, 94%, 95%, 96%, 97%, 98%, or 99% sequence identity thereto.

152. The TCR or antigen-binding fragment thereof of any of embodiment 107, wherein:

the Vα region comprises a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO: 1220), wherein $X_1$ is A, I, or V; $X_2$ is M, L, A, V, S, or E; $X_3$ is R, L, N, S, Q, K, G, or W; $X_4$ is E, V, P, T, F, A, G, N, D, or L; $X_5$ is G, I, D, L, A, P, N, R, T, or null; $X_6$ is G, N, R, T, M, S, P, or null; $X_7$ is G, V, D, L, Q, T, R, or null; $X_8$ is T, D, S, L, G, or null; $X_9$ is A, G, Q, or null; $X_{10}$ is G, or null; $X_{11}$ is G, or null; $X_{12}$ is T, or null; $X_{13}$ is S, A, T, G, or null; $X_{14}$ is G, Y, T, N, A, W, or null; $X_{15}$ is F, G, N, T, Y, D, S, R, Q, or E; $X_{16}$ is K, P, N, D, or Q; $X_{17}$ is L, M, I, V, or T; and $X_{18}$ is I, T, V, F, R, or Q; and/or the Vβ region comprises a complementarity determining region 3 (CDR-3) comprising the amino acid sequence $X_1X_2X_3X_4X_5X_6X_7X_8X_9X_{10}X_{11}X_{12}X_{13}X_{14}X_{15}$ (SEQ ID NO: 1222), wherein $X_1$ is A, S, or V; $X_2$ is S, A, or V; $X_3$ is S, R, or Q; $X_4$ is H, P, Q, L, Y, G, T, F, S, R, or E; $X_5$ is L, G, R, W, F, S, V, T, Y, Q, or null; $X_6$ is A, G, L, E, P, or null; $X_7$ is G, T, A, R, Q, N, S, or null; $X_8$ is G, S, or null; $X_9$ is G, or null; $X_{10}$ is F, G, A, S, T, R, Q, L, or null; $X_{11}$ is T, N, F, A, R, S, G, or null; $X_{12}$ is G, T, L D, Y, N, Q, S, or E; $X_{13}$ is E, W, T, G, K, N, or P; $X_{14}$ is L, A, K, Q, Y, or I; and $X_{15}$ is F, H, Y, T, or I.

153. A T cell receptor (TCR) or antigen-binding fragment thereof, comprising an alpha chain comprising a variable alpha (Vα) region and a beta chain comprising a variable beta (Vβ) region, wherein:

the Vα region comprises a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO: 1220), wherein $X_1$ is A, I, or V; $X_2$ is M, L, A, V, S, or E; $X_3$ is R, L, N, S, Q, K, G, or W; $X_4$ is E, V, P, T, F, A, G, N, D, or L; $X_5$ is G, I, D, L, A, P, N, R, T, or null; $X_6$ is G, N, R, T, M, S, P, or null; $X_7$ is G, V, D, L, Q, T, R, or null; $X_8$ is T, D, S, L, G, or null; $X_9$ is A, G, Q, or null; $X_{10}$ is G, or null; $X_{11}$ is G, or null; $X_{12}$ is T, or null; $X_{13}$ is S, A, T, G, or null; $X_{14}$ is G, Y, T, N, A, W, or null; $X_{15}$ is F, G, N, T, Y, D, S, R, Q, or E; $X_{16}$ is K, P, N, D, or Q; $X_{17}$ is L, M, I, V, or T; and $X_{18}$ is I, T, V, F, R, or Q; and/or the Vβ region comprises a complementarity determining region 3 (CDR-3) comprising the amino acid sequence $X_1X_2X_3X_4X_5X_6X_7X_8X_9X_{10}X_{11}X_{12}X_{13}X_{14}X_{15}$ (SEQ ID NO: 1222), wherein $X_1$ is A, S, or V; $X_2$ is S, A, or V; $X_3$ is S, R, or Q; $X_4$ is H, P, Q, L, Y, G, T, F, S, R, or E; $X_5$ is L, G, R, W, F, S, V, T, Y, Q, or null; $X_6$ is A, G, L, E, P, or null; $X_7$ is G, T, A, R, Q, N, S, or null; $X_8$ is G, S, or null; $X_9$ is G, or null; $X_{10}$ is F, G, A, S, T, R, Q, L, or null; $X_{11}$ is T, N, F, A, R, S, G, or null; $X_{12}$ is G, T, L D, Y, N, Q, S, or E; $X_{13}$ is E, W, T, G, K, N, or P; $X_{14}$ is L, A, K, Q, Y, or I; and $X_{15}$ is F, H, Y, T, or I.

154. The TCR or antigen-binding fragment thereof of embodiment 46 or embodiment 153, wherein the Vα region comprises a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}LT$ (SEQ ID NO:1206), wherein $X_1$ is A, I, or V; $X_2$ is L, M, V, or E; $X_3$ is L, R, N, G, or S; $X_4$ is V, T, F, N, E, P, G, or L; $X_5$ is I, A, P, N, G, or T; $X_6$ is R, G, S, or T; $X_7$ is G, R, L, V, or T; $X_8$ is T, G, L, or null; $X_9$ is A, G, Q, or null; $X_{10}$ is G, or null; $X_{11}$ is G, or null; $X_{12}$ is T, or null; $X_{13}$ is S, T, or G; $X_{14}$ is Y, A, G, or N; $X_{15}$ is G, S, N, R, or E; and $X_{16}$ is K, or Q;

the Vα region comprises a complementarity determining region 3 (CDR-3) comprising the amino acid sequence $AMRX_4X_5X_6X_7X_8X_9X_{10}X_{11}X_{12}X_{13}X_{14}X_{15}$ (SEQ ID NO:1207), wherein $X_4$ is E, T, A, D, or L; $X_5$ is G, A, N, or R; $X_6$ is R, G, R, T, M, or S; $X_7$ is G, V, D, L, or null; $X_8$ is T, D, or null; $X_9$ is G, or null; $X_{10}$ is S, T, G, or null; $X_{11}$ is G, Y, N, A, or W; $X_{12}$ is F, G, N, D, S, or Y; $X_{13}$ is K, D, or Q; $X_{14}$ is T, L, M, or I; $X_{15}$ is I, T, R, or Q;

the Vα region comprises a complementarity determining region 3 (CDR-3) comprising the amino acid sequence $X_1X_2X_3X_4X_5X_6X_7X_8X_9X_{10}X_{11}X_{12}X_{13}X_{14}X_{15}KX_{17}X_{18}$ (SEQ ID NO:1208), $X_1$ is I, or V; $X_2$ is L, or V; $X_3$ is L, N, or R; $X_4$ is V, F, or G; $X_5$ is I, P, G, or T; $X_6$ is R, S, P, or G; $X_7$ is G, R, Q, T, or V; $X_8$ is T, G, S, or L; $X_9$ is A, G, Q, or null; $X_{10}$ is G, or null; $X_{11}$ is G, or null; $X_{12}$ is T, or null; $X_{13}$ is G, or S; $X_{14}$ is Y, or N; $X_{15}$ is G, Q, or E; $X_{17}$ is V, or L; and $X_{18}$ is I, or T; or the Vα region comprises a complementarity determining region 3 (CDR-3) comprising the amino acid sequence $X_1X_2X_3X_4X_5X_6X_7X_8X_9X_{10}X_{11}X_{12}X_{13}X_{14}X_{15}X_{16}X_{17}X_{18}$ (SEQ ID NO: 248), wherein $X_1$ is A, I, or V; $X_2$ is M, L, or V; $X_3$ is R, L, or N; $X_4$ is E, V, T, P, or F; $X_5$ is G, I, L, A, or P; $X_6$ is R, T, G, or S; $X_7$ is G, R, or null; $X_8$ is T, G, or null; $X_9$ is null or A; $X_{10}$ is null or G; $X_{11}$ is null or G; $X_{12}$ is null or T; $X_{13}$ is null or S; $X_{14}$ is G, Y, or N; $X_{15}$ is F, G, or T; $X_{16}$ is K or P; $X_{17}$ is T or L; and $X_{18}$ is I, V or T.

155. The TCR or antigen-binding fragment thereof of any of embodiments 151-154, wherein:

the Vβ region comprises a complementarity determining region 3 (CDR-3) comprising the amino acid sequence ASS$X_4X_5X_6X_7X_8X_9X_{10}X_{11}X_{12}X_{13}X_{14}$ (SEQ ID NO:1212), wherein $X_4$ is H, P, Q, L, Y, F, R, or E; $X_5$ is L, G, R, W, F, S, V, T, Y, or Q; $X_6$ is A, G, L, E or P; $X_7$ is G, T, A, R, Q, S, or null; $X_8$ is G, S, or null; $X_9$ is F, G, A, S, T, R, L, or null; $X_{10}$ is T, N, A, F, R, S, or G; $X_{11}$ is G, T, L, D, Y, Q, S, E, or N; $X_{12}$ is E, W, T, G, P, or K; $X_{13}$ is L, A, K, Q, Y, or I; and $X_{14}$ is F, H, Y, or T;

the Vβ region comprises a complementarity determining region 3 (CDR-3) comprising the amino acid sequence $X_1X_2SX_4X_5X_6X_7X_8X_9X_{10}X_{11}X_{12}X_{13}$QY (SEQ ID NO:1223), $X_1$ is A, or S; $X_2$ is 5, V, or A; $X_4$ is L, Y, P, or S; $X_5$ is W, F, V, L, or Y; $X_6$ is G, or A; $X_7$ is A, R, Q, S, or null; $X_8$ is G, or null; $X_9$ is G, or null; $X_{10}$ is S, T, R, or G; $X_{11}$ is T, A, R, S, or N; $X_{12}$ is D, Y, T, or G; and $X_{13}$ is T, or E;

the Vβ region comprises a complementarity determining region 3 (CDR-3) comprising the amino acid sequence AS$X_3 X_4 X_5 X_6 X_7 X_8 X_9 X_{10} X_{11} X_{12}$F (SEQ ID NO:1214), wherein $X_3$ is S, Q, or R; $X_4$ is H, P, T, or E; $X_5$ is L, G, W, or F; $X_6$ is A, G, or null; $X_7$ is G, N, S, R, or null; $X_8$ is F, G, Q, L, A, or null; $X_9$ is T, N, or A; $X_{10}$ is G, T, N, or E; $X_{11}$ is E, N, or K; and $X_{12}$ is L, A, or Q;

the Vβ region comprises a complementarity determining region 3 (CDR-3) comprising the amino acid sequence ASS$X_4 X_5 X_6 X_7 X_8$ NY$X_{11}$ YT (SEQ ID NO: 1215), $X_4$ is L, or R; $X_5$ is S, or T; $X_6$ is G, T, or A; $X_7$ is T, or null; $X_8$ is G, or null; and $X_{11}$ is G, or null; or the Vβ region comprises a complementarity determining region 3 (CDR-3) comprising the amino acid sequence ASS$X_4X_5X_6X_7X_8X_9X_{10}X_{11}X_{12}X_{13}$ (SEQ ID NO: 258), wherein $X_4$ is H, P, L, or Y; $X_5$ is L, G, W, F, or S; $X_6$ is A, G, or L; $X_7$ is G, E, A, T, or null; $X_8$ is F, G, T, or S; $X_9$ is T, N, H, or A; $X_{10}$ is G, T, Q, D, or Y; $X_{11}$ is E, P, T, or G; $X_{12}$ is L, A, Q, or Y; and $X_{13}$ is F, H, Y, or T.

156. The TCR or antigen-binding fragment thereof of any of embodiments 151-155, wherein the Vα region comprises a complementarity determining region 1 (CDR-1) comprising:

the amino acid sequence $X_1 X_2 X_3 X_4 X_5 X_6 X_7$ (SEQ ID NO:1209), wherein $X_1$ is T, N, D, or S; $X_2$ is 5, I, or R; $X_3$ is D, S, M, A, Y, N, or G; $X_4$ is Q, G, P, or null; $X_5$ is S, T, F, I, or N; $X_6$ is Y, D, Q, P, N, or E; and $X_7$ is G, Y, N, S, or A; or the amino acid sequence $X_1X_2X_3X_4X_5X_6X_7$ (SEQ ID NO: 240), wherein $X_1$ is T, D, or N; $X_2$ is I, or S; $X_3$ is S, D, or A; $X_4$ is G, Q, P, or null; $X_5$ is T, S, or I; $X_6$ is D, Y, or Q; and $X_7$ is Y, G, N, or Q.

157. The TCR or antigen-binding fragment thereof of any of embodiments 151-156, wherein the Vα region comprises a complementarity determining region 2 (CDR-2) comprising:

the amino acid sequence $X_1 X_2 X_3 X_4 X_5 X_6 X_7 X_8$ (SEQ ID NO:1210), wherein $X_1$ is Q, G, I, V, Y, M, R, or N; $X_2$ is G, L, S, Q, Y, T, N, or V; $X_3$ is S, T, L, or K; $X_4$ is Y, I, S, A, N, F, or null; $X_5$ is D, A, or null; $X_6$ is E, K, Q, S, T, G, D, or null; $X_7$ is Q, S, N, R, G, L, or D; and $X_8$ is N, K, E, V, or L; or the amino acid sequence $X_1X_2X_3X_4X_5X_6X_7X_8$ (SEQ ID NO: 244), wherein $X_1$ is G, Q, I, or V; $X_2$ is L, S, Q, or Y; $X_3$ is T, G, or S; $X_4$ is Y, S, or null; $X_5$ is null or D; $X_6$ is null, E, Q, or S; $X_7$ is S, Q, R, or G; and $X_8$ is N or E.

158. The TCR or antigen-binding fragment thereof of any of embodiments 151-157, wherein the Vβ region comprises a complementarity determining region 1 (CDR-1) comprising:

the amino acid sequence $X_1 X_2 X_3 X_4 X_5 X_6$ (SEQ ID NO:1218), wherein $X_1$ is S, M, D, or L; $X_2$ is G, E, D, N, Q, S, or F; $X_3$ is H, V, Y, N, or Q; $X_4$ is A, S, F, or null; $X_5$ is W V, N, E, T, P, Y, K, D, or L; and $X_6$ is S, R, A, N, Y, M, or T; or the amino acid sequence $X_1X_2HX_4X_5$ (SEQ ID NO: 252), wherein $X_1$ is S or M; $X_2$ is G, E, D, or N; $X_4$ is V, N, or E; and $X_5$ is S, R, N, or Y.

159. The TCR or antigen-binding fragment thereof of any of embodiments 151-158, wherein the Vβ region comprises a complementarity determining region 2 (CDR-2) comprising:

the amino acid sequence $X_1 X_2 X_3 X_4 X_5 X_6 X_7$ (SEQ ID NO:1219), wherein $X_1$ is F, Y, S, A or M; $X_2$ is N, Q, V, T, Y, or A; $X_3$ is N, D, E, S, G, I, F, Q, or L; $X_4$ is G, A, N, or null; $X_5$ is E, K, V, E, S, T, G, or N; $X_6$ is A, E, K, G, L, D, V, or N; $X_7$ is Q, M, T, A, V, E, P, D, or I; or the amino acid sequence $X_1X_2X_3X_4X_5X_6$ (SEQ ID NO: 255), wherein $X_1$ is F or S; $X_2$ is Q, Y, or V; $X_3$ is N, D, or G; $X_4$ is E or V; $X_5$ is A, K, or G; and $X_6$ is Q, M, or T.

160. The TCR or antigen-binding fragment thereof of any of embodiments 151-159, wherein the TCR or antigen-binding fragment thereof binds to or recognizes a peptide epitope of human papillomavirus (HPV) 16 E6 in the context of an MHC molecule, the peptide epitope is or comprises E6(29-38) TIHDIILECV (SEQ ID NO:233).

161. The TCR or antigen-binding fragment of any of embodiments 151-160, wherein:

the Vα region comprises a complementarity determining region 3 (CDR-3) comprising an amino acid sequence set forth in any of SEQ ID NOs: 138, 144, 147, 163, 167, 173, 304, or 308, or a CDR3 contained within the amino acid sequence set forth in any of SEQ ID NOs: 111, 113, 115, 121, 123, 125, 297, or 299; and/or a Vβ region comprising a complementarity determining region 3 (CDR-3) comprising an amino acid sequence set forth in any of SEQ ID NOs: 141, 146, 150, 164, 170, 174, 305, or 309, or a CDR3 contained within the amino acid sequence set forth in any of SEQ ID NOs: 112, 114, 116, 122, 124, 126, 298, or 300.

162. The TCR or antigen-binding fragment of any of embodiments 151-161, wherein the Vα region further comprises:

a complementarity determining region 1 (CDR-1) comprising an amino acid sequence set forth in any of SEQ ID NOs: 136, 142, 161, 165, 171, 302, or 306, or a CDR-1 contained within the amino acid sequence set forth in any of SEQ ID NOs: 111, 113, 115, 121, 123, 125, 297, or 299; and/or a complementarity determining region 2 (CDR-2) comprising an amino acid sequence set forth in any of SEQ ID NOs: 137, 143, 162, 166, 172, 303, or 307, or a CDR-2 contained within the amino acid sequence set forth in any of SEQ ID NOs: 111, 113, 115, 121, 123, 125, 297, or 299.

163. The TCR or antigen-binding fragment of any of embodiments 151-152, wherein the Vβ region comprises:

a complementarity determining region 1 (CDR-1) comprising an amino acid sequence set forth in any of SEQ ID NOs: 139, 145, 148, 168, or a CDR-1 contained within the amino acid sequence set forth in any of SEQ ID NOs: 112, 114, 116, 122, 124, 126, 298, or 300; and/or a complementarity determining region 2 (CDR-2) comprising an amino acid sequence set forth in any of SEQ ID NOs: 140, 149, or 169 or a CDR-2 contained within the amino acid sequence set forth in any of SEQ ID NOs: 112, 114, 116, 122, 124, 126, 298, or 300.

164. The TCR or antigen-binding fragment thereof of any of embodiments 151-163, wherein:

the Vα region comprises: a complementarity determining region 1 (CDR-1) comprising an amino acid sequence set forth in any of SEQ ID NOs: 136, 142, 161, 165, 171, 302, or 306; a complementarity determining region 2 (CDR-2) comprising an amino acid sequence set forth in any of SEQ ID NOs: 137, 143, 162, 166, 172, 303, or 307; and/or a complementarity determining region 3 (CDR-3) comprising an amino acid sequence set forth in any of SEQ ID NOs: 138, 144, 147, 163, 167, 173, 304, 308; and/or the Vβ region comprises: a complementarity determining region 1 (CDR-1) comprising an amino acid sequence set forth in any of SEQ ID NOs: 139, 145, 148, or 168; a complementarity determining region 2 (CDR-2) comprising an amino acid sequence set forth in any of SEQ ID NOs: 140, 149, or 169; and/or a complementarity determining region 3 (CDR-3) comprising an amino acid sequence set forth in any of SEQ ID NOs: 141, 146, 150, 164, 170, 174, 305, or 309.

165. The TCR or antigen-binding fragment thereof of any of embodiments 151-164, wherein:

the Vα region comprises a CDR-1, CDR-2, and CDR-3, comprising the amino acid sequences of SEQ ID NOs: 136, 137, and 138, respectively, and the Vβ region comprises a CDR-1, CDR-2, and CDR-3, comprising the amino acid sequences of SEQ ID NOs: 139, 140, and 141, respectively;

the Vα region comprises a CDR-1, CDR-2, and CDR-3, comprising the amino acid sequences of SEQ ID NOs: 142, 143, and 144, respectively, and the Vβ region comprises a CDR-1, CDR-2, and CDR-3, comprising the amino acid sequences of SEQ ID NOs: 145, 140, and 146, respectively;

the Vα region comprises a CDR-1, CDR-2, and CDR-3, comprising the amino acid sequences of SEQ ID NOs: 136, 137, and 147, respectively, and the Vβ region comprises a CDR-1, CDR-2, and CDR-3, comprising the amino acid sequences of SEQ ID NOs: 148, 149, and 150, respectively;

the Vα region comprises a CDR-1, CDR-2, and CDR-3, comprising the amino acid sequences of SEQ ID NOs: 161, 162, and 163, respectively, and the Vβ region comprises a CDR-1, CDR-2, and CDR-3, comprising the amino acid sequences of SEQ ID NOs: 148, 149, and 164, respectively;

the Vα region comprises a CDR-1, CDR-2, and CDR-3, comprising the amino acid sequences of SEQ ID NOs: 165, 166, and 167, respectively, and the Vβ region comprises a CDR-1, CDR-2, and CDR-3, comprising the amino acid sequences of SEQ ID NOs: 168, 169, and 170, respectively;

the Vα region comprises a CDR-1, CDR-2, and CDR-3, comprising the amino acid sequences of SEQ ID NOs: 171, 172, and 173, respectively, and the Vβ region comprises a CDR-1, CDR-2, and CDR-3, comprising the amino acid sequences of SEQ ID NOs: 148, 149, and 174, respectively;

the Vα region comprises a CDR-1, CDR-2, and CDR-3, comprising the amino acid sequences of SEQ ID NOs: 302, 303, and 304, respectively, and the Vβ region comprises a CDR-1, CDR-2, and CDR-3, comprising the amino acid sequences of SEQ ID NOs: 139, 140, and 305, respectively;

the Vα region comprises a CDR-1, CDR-2, and CDR-3, comprising the amino acid sequences of SEQ ID NOs: 306, 307, and 308, respectively, and the Vβ region comprises a CDR-1, CDR-2, and CDR-3, comprising the amino acid sequences of SEQ ID NOs: 148, 149, and 309, respectively.

166. The TCR or antigen-binding fragment thereof of any of embodiments 151-165, wherein:

the Vα region comprises a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 111, 113, 115, 121, 123, 125, 297, or 299; and/or the Vβ region comprises a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 112, 114, 116, 122, 124, 126, 298, or 300.

167. The TCR or antigen-binding fragment thereof of any of embodiments 151-166, wherein:

the Vα and Vβ regions comprise the amino acid sequences of SEQ ID NOs: 111 and 112, respectively;

the Vα and Vβ regions comprise the amino acid sequences of SEQ ID NOs: 113 and 114, respectively;

the Vα and Vβ regions comprise the amino acid sequences of SEQ ID NOs: 115 and 116, respectively;

the Vα and Vβ regions comprise the amino acid sequences of SEQ ID NOs: 121 and 122, respectively;

the Vα and Vβ regions comprise the amino acid sequences of SEQ ID NOs: 123 and 124, respectively;

the Vα and Vβ regions comprise the amino acid sequences of SEQ ID NOs: 125 and 126, respectively;

the Vα and Vβ regions comprise the amino acid sequences of SEQ ID NOs: 297 and 298, respectively;

the Vα and Vβ regions comprise the amino acid sequences of SEQ ID NOs: 299 and 300, respectively.

168. The TCR or antigen-binding fragment thereof of any of embodiments 151-167, wherein the alpha chain further comprises an alpha constant (Cα) region and/or the beta chain further comprises a beta constant (Cβ) region.

169. The TCR or antigen-binding fragment thereof of embodiment 168, wherein the Cα and Cβ regions are mouse constant regions.

170. The TCR or antigen-binding fragment thereof of embodiment 168 or embodiment 63, wherein:

the Cα region comprises the amino acid sequence set forth in SEQ ID NO: 262, 833, 1012, 1014, 1015, 1017, 1018, or a sequence of amino acids that has at least 90% sequence identity thereto; and/or the Cβ region comprises the amino acid sequence set forth in SEQ ID NO: 263, 1013 or 1016 or a sequence of amino acids that has at least 90% sequence identity thereto.

171. The TCR or antigen-binding fragment thereof of embodiment 168, wherein the Cα and Cβ regions are human constant regions.

172. The TCR or antigen-binding fragment thereof of embodiment 168 or embodiment 65, wherein:
the Cα region comprises the amino acid sequence set forth in any of SEQ ID NOs: 212, 213, 215, 217, 218, 220 or 524, or a sequence of amino acids that has at least 90% sequence identity thereto; and/or
the Cβ region comprises the amino acid sequence set forth in any of SEQ ID NOs: 214, 216, 631 or 889, or a sequence of amino acids that has at least 90% sequence identity thereto.

173. The TCR or antigen-binding fragment thereof of any of embodiments 151-172, comprising one or more modifications in the α chain and/or β chain such that when the TCR or antigen-binding fragment thereof is expressed in a cell, the frequency of mispairing between the TCR α chain and β chain and an endogenous TCR α chain and β chain is reduced, the expression of the TCR α chain and β chain is increased and/or the stability of the TCR α chain and β chain is increased, each compared to expression in a cell of the TCR or antigen-binding fragment thereof not containing the one or more modifications.

174. The TCR or antigen-binding fragment thereof of embodiment 173, wherein the one or more modifications is a replacement, deletion, or insertion of one or more amino acids in the Cα region and/or the Cβ region.

175. The TCR or antigen-binding fragment thereof of embodiment 173 or embodiment 68, wherein the one or more modifications comprise replacement(s) to introduce one or more cysteine residues that are capable of forming one or more non-native disulfide bridges between the alpha chain and beta chain.

176. The TCR or antigen-binding fragment thereof of any of embodiments 151-168 and 171-175, comprising a Cα region comprising a cysteine at a position corresponding to position 48 with numbering as set forth in SEQ ID NO: 212, 213, 217, 218, or 524 or at a position corresponding to position 49 with numbering as set forth in SEQ ID NO: 215 or 220; and/or a Cβ region comprising a cysteine at a position corresponding to position 57 with numbering as set forth in SEQ ID NO: 214 or 216 or at a position corresponding to position 58 with numbering as set forth in SEQ ID NO: 631 or 889.

177. The TCR or antigen-binding fragment thereof of any of embodiments 168, 171, and 173-176, wherein:
the Cα region comprises the amino acid sequence set forth in any of SEQ ID NOs: 196, 198, 200, 201, 203, or 525, or a sequence of amino acids that has at least 90% sequence identity thereto comprising one or more cysteine residues capable of forming a non-native disulfide bond with the beta chain; and/or
the Cβ region comprises the amino acid sequence set forth in any of SEQ ID NOs: 197, 199, 632, or 890 or a sequence of amino acids that has at least 90% sequence identity thereto that contains one or more cysteine residues capable of forming a non-native disulfide bond with the alpha chain.

178. The TCR or antigen-binding fragment thereof of any of embodiments 151-177, wherein the TCR or antigen-binding fragment thereof is encoded by a nucleotide sequence that has been codon-optimized.

179. The TCR or antigen-binding fragment thereof of any of embodiments 151-178, wherein:

a) the alpha chain comprises:
the amino acid sequence set forth in any of SEQ ID NOs: 18, 28, 38, 68, 78, 88, 287, or 291, a sequence of amino acids that has at least 90% sequence identity thereto; or an amino acid sequence encoded by the nucleotide sequence set forth in any of SEQ ID NOs: 20, 30, 40, 70, 80, 90, 202 or 219 or a nucleotide sequence that has at least 90% sequence identity thereto; and/or
the beta chain comprises:
the amino acid sequence set forth in any of SEQ ID NOs: 22, 32, 42, 72, 82, 92, 289, or 293, a sequence of amino acids that has at least 90% sequence identity thereto; or an amino acid sequence encoded by the nucleotide sequence set forth in any of SEQ ID NOS: 16, 17, 24, 34, 44, 74, 84, 94, or a nucleotide sequence that has at least 90% sequence identity thereto; or b) the alpha and beta chains comprise the amino acid sequences of SEQ ID NOs: 18 and 22, respectively; the alpha and beta chains comprise the amino acid sequences of SEQ ID NOs: 28 and 32, respectively; the alpha and beta chains comprise the amino acid sequences of SEQ ID NOs: 38 and 42, respectively; the alpha and beta chains comprise the amino acid sequences of SEQ ID NOs: 68 and 72, respectively; the alpha and beta chains comprise the amino acid sequences of SEQ ID NOs: 78 and 82, respectively; the alpha and beta chains comprise the amino acid sequences of SEQ ID NOs: 88 and 92, respectively; the alpha and beta chains comprise the amino acid sequences of SEQ ID NOs: 287 and 289, respectively; or the alpha and beta chains comprise the amino acid sequences of SEQ ID NOs: 291 and 293, respectively.

180. The TCR or antigen-binding fragment thereof of any of embodiments 151-178, wherein:
a) the alpha chain comprises:
the amino acid sequence set forth in any of SEQ ID NOs: 19, 29, 39, 69, 79, 89, 288 or 292, a sequence of amino acids that has at least 90% sequence identity thereto that contains one or more cysteine residues capable of forming a non-native disulfide bond with the beta chain; or an amino acid sequence encoded by the nucleotide sequence set forth in any of SEQ ID NOs: 10, 11, 21, 31, 41, 71, 81, 91, or a nucleotide sequence that has at least 90% sequence identity thereto and encodes an alpha chain that contains one or more cysteine residues capable of forming a non-native disulfide bond with the beta chain; and/or
the beta chain comprises
the amino acid sequence set forth in any of SEQ ID NOs: 23, 33, 43, 73, 83, 93, 290, or 294, a sequence of amino acids that has at least 90% sequence identity thereto that contains one or more cysteine residues capable of forming a non-native disulfide bond with the alpha chain; or an amino acid sequence encoded by the nucleotide sequence set forth in any of SEQ ID NOs: 7, 8, 25, 35, 45, 75, 85, 95, or a nucleotide sequence that has at least 90% sequence identity thereto and encodes a beta chain that contains one or more cysteine residues capable of forming a non-native disulfide bond with the alpha chain; or b) the alpha and beta chains comprise the amino acid sequences of SEQ ID NOs: 19 and 23, respectively; the alpha and beta chains comprise the amino acid sequences of SEQ ID NOs: 29 and 33, respectively; the alpha and beta chains comprise the amino acid sequences of SEQ ID NOs: 39 and 43, respectively; the alpha and beta chains comprise the amino acid sequences of SEQ ID NOs: 69 and 73, respectively; the alpha and beta chains comprise the amino acid sequences of SEQ ID NOs: 79 and 83, respectively; the alpha and beta chains comprise the amino acid sequences of SEQ ID NOs: 89 and 93, respectively; the alpha and beta chains comprise the amino acid sequences of SEQ ID NOs: 288 and 290, respectively; the alpha and beta chains comprise the amino acid sequences of SEQ ID NOs: 292 and 294, respectively.

181. The TCR or antigen-binding fragment thereof of any of embodiments 151-180, wherein the alpha and/or beta chain further comprises a signal peptide.

182. The TCR or antigen-binding fragment thereof of embodiment 181, wherein:
the alpha chain comprises the signal peptide comprising the amino acid sequence set forth in any of SEQ ID NOs: 181, 184, 187, 189, 190, 192, 193, 310, 311; and/or
the beta chain comprises the signal peptide comprising the amino acid sequence set forth in any of SEQ ID NOs: 182, 185, 186, 188, 191, or 194.

183. The TCR or antigen-binding fragment thereof of any of embodiments 151-182, that is isolated or purified or is recombinant.

184. The TCR or antigen-binding fragment thereof of any of embodiments 151-183, that is human.

185. The TCR or antigen-binding fragment thereof of any of embodiments 151-184, that is monoclonal.

186. The TCR or antigen-binding fragment thereof of any of embodiments 151-185, wherein the TCR or antigen-binding fragment thereof is single chain.

187. The TCR or antigen-binding fragment thereof of any of embodiments 151-185, wherein the TCR or antigen-binding fragment thereof comprises two chains.

188. The TCR or antigen-binding fragment thereof of any of embodiments 151-187, wherein the antigen-specificity is at least partially CD8-independent.

189. The TCR or antigen-binding fragment of any of embodiments 151-188 wherein the MHC molecule is an HLA-A2 molecule.

190. A nucleic acid molecule encoding the TCR or antigen-binding fragment thereof of any of embodiments 151-189, or an alpha or beta chain thereof.

191. The nucleic acid molecule of embodiment 190, comprising a nucleotide sequence encoding an alpha chain and/or a nucleotide sequence encoding a beta chain, wherein:
the nucleotide sequence encoding an alpha chain comprises the sequence selected from the group consisting of: residues 61-816 of SEQ ID NO: 20, residues 58-804 of SEQ ID NO: 30, residues 61-825 of SEQ ID NO: 40, residues 58-807 of SEQ ID NO: 70, residues 61-825 of SEQ ID NO: 80, residues 67-831 of SEQ ID NO: 90, residues 58-801 of SEQ ID NO: 202, residues 67-813 of SEQ ID NO: 219, or a sequence having at least 90% sequence identity thereto; and/or
the nucleotide sequence encoding a beta chain comprises the sequence selected from the group consisting of: residues 58-930 of SEQ ID NO: 16, residues 58-936 of SEQ ID NO: 17, residues 58-939 of SEQ ID NO: 24, residues 64-930 of SEQ ID NO: 34 or 44, residues 64-936 of SEQ ID NO: 74, residues 58-933 of SEQ ID NO: 84, residues 63-930 of SEQ ID NO: 94, or a sequence having at least 90% sequence identity thereto.

192. The nucleic acid molecule of embodiment 190, wherein the nucleotide sequence is codon-optimized.

193. The nucleic acid molecule of embodiment 190 or embodiment 192, comprising a nucleotide sequence encoding an alpha chain and/or a nucleotide sequence encoding a beta chain, wherein:
the nucleotide sequence encoding an alpha chain comprises the sequence selected from the group consisting of: residues 67-825 of SEQ ID NO: 10, residues 58-813 of SEQ ID NO: 11, residues 61-825 of SEQ ID NO: 21, residues 58-813 of SEQ ID NO: 31, residues 61-834 of SEQ ID NO: 41, residues 58-816 of SEQ ID NO: 71, residues 61-834 of SEQ ID NO: 81, residues 67-840 of SEQ ID NO: 91, or a sequence having at least 90% sequence identity thereto; and/or
the nucleotide sequence encoding a beta chain comprises the sequence selected from the group consisting of: residues 58-930 of SEQ ID NO: 7, residues 58-936 of SEQ ID NO: 8, residues 58-939 of SEQ ID NO: 25, residues 64-930 of SEQ ID NO: 35, 45, or 95, residues 58-933 of SEQ ID NO: 85, residues 64-936 of SEQ ID NO: 75, or a sequence having at least 90% sequence identity thereto.

194. The nucleic acid molecule of any of embodiments 190-193, wherein the nucleotide sequence encoding the alpha chain and the nucleotide sequence encoding the beta chain are separated by a peptide sequence that causes ribosome skipping.

195. The nucleic acid molecule of embodiment 194, wherein the peptide that causes ribosome skipping is a P2A or T2A peptide and/or comprises the sequence of amino acids set forth in SEQ ID NO: 204 or 211.

196. The nucleic acid of any of embodiments 190-195, comprising the nucleotide sequence set forth in any of SEQ ID NOs: 13, 14, 26, 36, 46, 76, 86, 96, or a nucleotide sequence having at least 90% sequence identity thereto.

197. The nucleic acid of any of embodiments 144-151 and 190-196, wherein the nucleic acid is synthetic.

198. The nucleic acid of any of embodiments 144-151 and 190-197, wherein the nucleic acid is cDNA.

199. A vector comprising the nucleic acid of any of embodiments 144-150 and 190-198.

200. The vector of embodiment 199, wherein the vector is an expression vector.

201. The vector of embodiment 199 or embodiment 200, wherein the vector is a viral vector.

202. The vector of embodiment 201, wherein the viral vector is a retroviral vector.

203. The vector of embodiment 201 or embodiment 202, wherein the viral vector is a lentiviral vector.

204. The vector of embodiment 203, wherein the lentiviral vector is derived from HIV-1.

205. An engineered cell comprising the nucleic acid molecule of any of embodiments 144-150 and 190-198 or vector of any of embodiments 199-204.

206. An engineered cell, comprising the TCR or antigen-binding fragment thereof of any of embodiments 107-143 and 151-189.

207. The engineered cell of embodiment 205 or embodiment 206, wherein the TCR or antigen-binding fragment thereof is heterologous to the cell.

208. The engineered cell of any of embodiments 205-207, wherein the engineered cell is a cell line.

209. The engineered cell of any of embodiments 205-207, wherein the engineered cell is a primary cell obtained from a subject.

210. The engineered cell of embodiment 209, wherein the subject is a mammalian subject.

211. The engineered cell of embodiment 209 or embodiment 210, wherein the subject is a human.

212. The engineered cell of any of embodiments 205-211, wherein the engineered cell is a T cell.

213. The engineered cell of embodiment 212, wherein the T cell is CD8+.

214. The engineered cell of embodiment 212, wherein the T cell is CD4+.

215. The engineered cell of any of embodiments 205-214, comprising a genetic disruption of a T cell receptor alpha constant (TRAC) gene and/or a T cell receptor beta constant (TRBC) gene.

216. The engineered cell of embodiment 215, wherein the TRBC gene is one or both of a T cell receptor beta constant 1 (TRBC1) or T cell receptor beta constant 2 (TRBC2) gene.

217. A method for producing a cell of any of embodiments 205-216, comprising introducing a vector of any of embodiments 199-204 into a cell in vitro or ex vivo.

218. The method of embodiment 217, wherein the vector is a viral vector and the introducing is carried out by transduction.

219. The method of embodiment 217 or embodiment 218, further comprising introducing into the cell one or more agent, wherein each of the one or more agent is independently capable of inducing a genetic disruption of a T cell receptor alpha constant (TRAC) gene and/or a T cell receptor beta constant (TRBC) gene.

220. The method of any of embodiment 219, wherein the one or more agent capable of inducing a genetic disruption comprises a DNA binding protein or DNA-binding nucleic acid that specifically binds to or hybridizes to the target site.

221. The method of embodiment 220, wherein the one or more agent capable of inducing a genetic disruption comprises (a) a fusion protein comprising a DNA-targeting protein and a nuclease or (b) an RNA-guided nuclease.

222. The method of embodiment 221, wherein the DNA-targeting protein or RNA-guided nuclease comprises a zinc finger protein (ZFP), a TAL protein, or a clustered regularly interspaced short palindromic nucleic acid (CRISPR)-associated nuclease (Cas) specific for a target site within the TRAC and/or TRBC gene.

223. The method of embodiment 222, wherein the one or more agent comprises a zinc finger nuclease (ZFN), a TAL-effector nuclease (TALEN), or and a CRISPR-Cas9 combination that specifically binds to, recognizes, or hybridizes to the target site.

224. The method of embodiment 222 or embodiment 223, wherein the each of the one or more agent comprises a guide RNA (gRNA) having a targeting domain that is complementary to the at least one target site.

225. The method of embodiment 224, wherein the one or more agent is introduced as a ribonucleoprotein (RNP) complex comprising the gRNA and a Cas9 protein.

226. The method of embodiment 225, wherein the RNP is introduced via electroporation, particle gun, calcium phosphate transfection, cell compression or squeezing.

227. The method of embodiment 225 or embodiment 226, wherein the RNP is introduced via electroporation.

228. The method of any of embodiments 224-227, wherein the one or more agent is introduced as one or more polynucleotide encoding the gRNA and/or a Cas9 protein.

229. A composition comprising engineered cells of any of embodiments 205-216.

230. The composition of embodiment 229, wherein the engineered cells comprise CD4+ and/or CD8+ T cells.

231. The composition of embodiment 229 or embodiment 230, wherein the engineered cells comprise CD4+ and CD8+ T cells.

232. A composition, comprising an engineered CD8+ cell of embodiment 107 and an engineered CD4+ cell of embodiment 214.

233. The composition of any of embodiments 229-232, wherein the TCR or antigen-binding fragment thereof binds to or recognizes a peptide epitope of HPV 16 in the context of an MHC molecule that is at least partially CD8-independent.

234. The composition of any of embodiments 230-233, wherein the CD8+ cell and CD4+ cell are engineered with the same TCR or antigen-binding fragment thereof and/or are each engineered with a TCR or antigen-binding fragment thereof that binds to or recognizes the same peptide epitope of HPV 16 in the context of an MHC molecule.

235. The composition of any of embodiments 229-234, further comprising a pharmaceutically acceptable excipient.

236. A method of treatment, comprising administering the engineered cell of any of embodiments 205-216 to a subject having a disease or disorder associated with HPV.

237. A method of treatment, comprising administering the composition of any of embodiments 229-235 to a subject having a disease or disorder associated with HPV.

238. The method of embodiment 236 or embodiment 237, wherein the disease or disorder is associated with HPV16.

239. The method of any of embodiments 236-237, wherein the disease or disorder is cancer.

240. The method of any of embodiments 236-239, wherein the subject is a human.

241. A composition of any of embodiments 229-235 for use in treating a disease or disorder associated with HPV.

242. Use of a composition of any of embodiments 229-235 for the manufacture of a medicament for treating a disease or disorder associated with HPV.

243. The composition of embodiment 241 or use of embodiment 136, wherein the disease or disorder is associated with HPV16.

244. The composition or use of any of embodiments 241-243, wherein the disease or disorder is cancer.

245. The composition or use of any of embodiments 241-244, wherein the subject is a human.

246. A T cell receptor (TCR) or antigen-binding fragment thereof, comprising an alpha chain comprising a variable alpha (Vα) region and a beta chain comprising a variable beta (Vβ) region, wherein:

the Vα region comprises the amino acid sequence set forth in any of SEQ ID NOs: 691, 709, 726, 741, 759, 775, 787, 799, 815, 830, 845, 857, 869, 881, 895, 908, 925, 937, 951, 963, 975, 987 or 999, or an amino acid sequence that has at least 90%, 91%, 92%, 93%, 94%, 95%, 96%, 97%, 98%, or 99% sequence identity thereto; and/or the Vβ region comprises the amino acid sequence set forth in any of SEQ ID NOs: 700, 718, 735, 750, 768, 781, 793, 808, 824, 839, 851, 863, 875, 887, 901, 917, 931, 945, 957, 969, 981, 993 or 1008, or an amino acid sequence that has at least 90%, 91%, 92%, 93%, 94%, 95%, 96%, 97%, 98%, or 99% sequence identity thereto.

247. The TCR or antigen-binding fragment thereof of embodiment 246, wherein:

the Vα region comprises a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO:1185), wherein $X_2$ is A, G, V, Q, M, or E; $X_3$ is S, G, N, A, Y, R, or P; $X_4$ is E, S, A, G, F, N, D, V, P, L, I, M, or R; $X_5$ is R, N, H, T, D, G, S, P, L, Q, or F; $X_6$ is G, H, A, S, T, or null; $X_7$ is T, S, G, or null; $X_8$ is G, or null; $X_9$ is G, N, S, or null; $X_{10}$ is T, G, S, D, F, Y, A, or N; $X_{11}$ is Y, F, Q, R, or N; $X_{12}$ is K, Q, or D; $X_{13}$ is Y, L, T, M, F, or V; $X_{14}$ is I, T, S, R, Y, or V;

the Vα region comprises a complementarity determining region 3 (CDR-3) comprising the amino acid sequence $X_1X_2X_3X_4X_5X_6X_7X_8X_9X_{10}KX_{12}I$ (SEQ ID NO:1186), wherein $X_1$ is A, or V; $X_2$ is A, V, or E; $X_3$ is S, N, T, R, or P; $X_4$ is E, A, G, F, V, P, I, D, or S; $X_5$ is R, H, T, A P, S, G, or F; $X_6$ is G, H, L, T, S, or A, null; $X_7$ is S, T, or null; $X_8$ is G, or null; $X_9$ is G, T, or null; $X_{10}$ is F, Y, or N; $X_{12}$ is Y, T, or L;

the Vα region comprises a complementarity determining region 3 (CDR-3) comprising the amino acid sequence $AX_2X_3X_4X_5X_6X_7X_8X_9YKYI$ (SEQ ID NO:1187), wherein $X_2$ is A, V, or E; $X_3$ is S, N, or R; $X_4$ is E, G, V, P, I, or D; $X_5$ is R, T, P, S, G, or F; $X_6$ is G, T, S, or null; $X_7$ is S, or null; $X_8$ is G, or null; $X_9$ is T, or null;

the Vα region comprises a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO:1188), wherein $X_2$ is G, V, Q, or M; $X_3$ is G, A, Y, S, N, or R; $X_4$ is S, G, L, I, M, or R; $X_5$ is N, D, G, S, L, Q, or R; $X_6$ is A, S, G, or null; $X_7$ is G, or null; $X_8$ is G, or null; $X_9$ is G, N, S, or null; $X_{10}$ is S, D, Y, A, N, or null; $X_{11}$ is Y, Q, or R; $X_{12}$ is K, or Q; $X_{13}$ is L, or V; $X_{14}$ is S, T, or V;

the Vα region comprises a complementarity determining region 3 (CDR-3) comprising the amino acid sequence $AX_2X_3X_4X_5X_6X_7X_8X_9X_{10}X_{11}X_{12}X_{13}T$ (SEQ ID NO: 1189), wherein $X_2$ is G, V, or Q; $X_3$ is G, Y, S, or N; $X_4$ is S, L, or M; $X_5$ is N, G, L, or R; $X_6$ is A, S, G, or null; $X_7$ is G, or null; $X_8$ is G, or null; $X_9$ is G, S, or null; $X_{10}$ is S, Y, A, N, or null; $X_{11}$ is Y, Q, or R; $X_{12}$ is K, or Q; $X_{13}$ is L, or V;

the Vα region comprises a complementarity determining region 3 (CDR-3) comprising the amino acid sequence $AX_2X_3X_4X_5X_6X_7YKLS$ (SEQ ID NO:1190), wherein $X_2$ is G, or V; $X_3$ is A, or Y; $X_4$ is G, S, or R; $X_5$ is D, or S; $X_6$ is N, or null; $X_7$ is D, or null.

248. The TCR or antigen-binding fragment thereof of embodiment 246 or embodiment 247, wherein:

the Vβ region comprises a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO:1200), $X_2$ is 5, V, or I; $X_3$ is S, N, or A; $X_4$ is R, V, S, L, P, G, I, or A; $X_5$ is F, G, Y, L, V, R, T, or S; $X_6$ is L, G, A, D, R, V, or null; $X_7$ is G, D, R, S, T, or null; $X_8$ is S, or null; $X_9$ is S, H, G, V, T, D, L, or null; $X_{10}$ is T, S, A, G, P, N, or Y; $X_{11}$ is D, Y, E, G, or N; $X_{12}$ is T, E, G, or K; $X_{13}$ is Q, Y, or L; $X_{14}$ is Y, F, T, or I;

the Vβ region comprises a complementarity determining region 3 (CDR-3) comprising the amino acid sequence $ASSX_4X_5X_6X_7X_8X_9X_{10}X_{11}X_{12}X_{13}X_{14}$ (SEQ ID NO:1201), wherein $X_4$ is R, V, S, L, G, or A; $X_5$ is F, G, Y, L, V, T, or S; $X_6$ is A, L, R, D, G, or null; $X_7$ is G, D, T, or null; $X_8$ is S, or null; $X_9$ is S, H, G, T, D, L, or null; $X_{10}$ is T, S, A, G, P, N, or Y; $X_{11}$ is D, Y, E, G, or N; $X_{12}$ is T, E, or G; $X_{13}$ is Q, Y, or L; $X_{14}$ is Y, F, or T;

the Vβ region comprises a complementarity determining region 3 (CDR-3) comprising the amino acid sequence $ASSX_4X_5X_6X_7X_8X_9X_{10}TQY$ (SEQ ID NO: 1202), wherein $X_4$ is R, L, or G; $X_5$ is F, V, T, or Y; $X_6$ is L, or A, null; $X_7$ is G, or null; $X_8$ is S, G, or null; $X_9$ is T, G, P, or S; $X_{10}$ is D, or E.

249. A T cell receptor (TCR) or antigen-binding fragment thereof, comprising an alpha chain comprising a variable alpha (Vα) region and a beta chain comprising a variable beta (Vβ) region, wherein:

the Vα region comprises a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO:1185), wherein $X_2$ is A, G, V, Q, M, or E; $X_3$ is S, G, N, A, Y, R, or P; $X_4$ is E, S, A, G, F, N, D, V, P, L, I, M, or R; $X_5$ is R, N, H, T, D, G, S, P, L, Q, or F; $X_6$ is G, H, A, S, T, or null; $X_7$ is T, S, G, or null; $X_8$ is G, or null; $X_9$ is G, N, S, or null; $X_{10}$ is T, G, S, D, F, Y, A, or N; $X_{11}$ is Y, F, Q, R, or N; $X_{12}$ is K, Q, or D; $X_{13}$ is Y, L, T, M, F, or V; $X_{14}$ is I, T, S, R, Y, or V;

the Vα region comprises a complementarity determining region 3 (CDR-3) comprising the amino acid sequence $X_1X_2X_3X_4X_5X_6X_7X_8X_9X_{10}KX_{12}I$ (SEQ ID NO:1186), wherein $X_1$ is A, or V; $X_2$ is A, V, or E; $X_3$ is S, N, T, R, or P; $X_4$ is E, A, G, F, V, P, I, D, or S; $X_5$ is R, H, T, A P, S, G, or F; $X_6$ is G, H, L, T, S, or A, null; $X_7$ is S, T, or null; $X_8$ is G, or null; $X_9$ is G, T, or null; $X_{10}$ is F, Y, or N; $X_{12}$ is Y, T, or L;

the Vα region comprises a complementarity determining region 3 (CDR-3) comprising the amino acid sequence $AX_2X_3X_4X_5X_6X_7X_8X_9YKYI$ (SEQ ID NO:1187), wherein $X_2$ is A, V, or E; $X_3$ is S, N, or R; $X_4$ is E, G, V, P, I, or D; $X_5$ is R, T, P, S, G, or F; $X_6$ is G, T, S, or null; $X_7$ is S, or null; $X_8$ is G, or null; $X_9$ is T, or null;

the Vα region comprises a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO:1188), wherein $X_2$ is G, V, Q, or M; $X_3$ is G, A, Y, S, N, or R; $X_4$ is S, G, L, I, M, or R; $X_5$ is N, D, G, S, L, Q, or R; $X_6$ is A, S, G, or null; $X_7$ is G, or null; $X_8$ is G, or null; $X_9$ is G, N, S, or null; $X_{10}$ is S, D, Y, A, N, or null; $X_{11}$ is Y, Q, or R; $X_{12}$ is K, or Q; $X_{13}$ is L, or V; $X_{14}$ is S, T, or V;

the Vα region comprises a complementarity determining region 3 (CDR-3) comprising the amino acid sequence $AX_2X_3X_4X_5X_6X_7X_8X_9X_{10}X_{11}X_{12}X_{13}T$ (SEQ ID NO: 1189), wherein $X_2$ is G, V, or Q; $X_3$ is G, Y, S, or N; $X_4$ is S, L, or M; $X_5$ is N, G, L, or R; $X_6$ is A, S, G, or null; $X_7$ is G, or null; $X_8$ is G, or null; $X_9$ is G, S, or null; $X_{10}$ is S, Y, A, N, or null; $X_{11}$ is Y, Q, or R; $X_{12}$ is K, or Q; $X_{13}$ is L, or V;

the Vα region comprises a complementarity determining region 3 (CDR-3) comprising the amino acid sequence $AX_2X_3X_4X_5X_6X_7YKLS$ (SEQ ID NO:1190), wherein $X_2$ is G, or V; $X_3$ is A, or Y; $X_4$ is G, S, or R; $X_5$ is D, or S; $X_6$ is N, or null; $X_7$ is D, or null.

250. A T cell receptor (TCR) or antigen-binding fragment thereof, comprising an alpha chain comprising a variable alpha (Vα) region and a beta chain comprising a variable beta (Vβ) region, wherein:

the Vβ region comprises a complementarity determining region 3 (CDR-3) comprising the amino acid sequence $AX_2X_3X_4X_5X_6X_7X_8X_9X_{10}X_{11}X_{12}X_{13}X_{14}$ (SEQ ID NO:1200), $X_2$ is 5, V, or I; $X_3$ is S, N, or A; $X_4$ is R, V, S, L, P, G, I, or A; $X_5$ is F, G, Y, L, V, R, T, or S; $X_6$ is L, G, A, D, R, V, or null; $X_7$ is G, D, R, S, T, or null; $X_8$ is S, or null; $X_9$ is S, H, G, V, T, D, L, or null; $X_{10}$ is T, S, A, G, P, N, or Y; $X_{11}$ is D, Y, E, G, or N; $X_{12}$ is T, E, G, or K; $X_{13}$ is Q, Y, or L; $X_{14}$ is Y, F, T, or I;

the Vβ region comprises a complementarity determining region 3 (CDR-3) comprising the amino acid sequence $ASSX_4X_5X_6X_7X_8X_9X_{10}X_{11}X_{12}X_{13}X_{14}$ (SEQ ID NO:1201), wherein $X_4$ is R, V, S, L, G, or A; $X_5$ is F, G, Y, L, V, T, or S; $X_6$ is A, L, R, D, G, or null; $X_7$ is G, D, T, or null; $X_8$ is S, or null; $X_9$ is S, H, G, T, D, L, or null; $X_{10}$ is T, S, A, G, P, N, or Y; $X_{11}$ is D, Y, E, G, or N; $X_{12}$ is T, E, or G; $X_{13}$ is Q, Y, or L; $X_{14}$ is Y, F, or T;

the Vβ region comprises a complementarity determining region 3 (CDR-3) comprising the amino acid sequence ASSX$_4$X$_5$X$_6$X$_7$X$_8$X$_9$X$_{10}$TQY (SEQ ID NO: 1202), wherein X$_4$ is R, L, or G; X$_5$ is F, V, T, or Y; X$_6$ is L, or A, null; X$_7$ is G, or null; X$_8$ is S, G, or null; X$_9$ is T, G, P, or S; X$_{10}$ is D, or E.

251. A T cell receptor (TCR) or antigen-binding fragment thereof, comprising an alpha chain comprising a variable alpha (Vα) region and a beta chain comprising a variable beta (Vβ) region, wherein:

the Vα region comprises a complementarity determining region 3 (CDR-3) set forth in any of SEQ ID NOs: 694, 712, 729, 744, 762, 776, 788, 802, 818, 832, 846, 858, 870, 882, 896, 911, 926, 940, 952, 964, 976, 988, 1002 or a sequence that exhibits at least 60%, 65%, 70%, 75%, 80%, 85%, 90% or 95% sequence identity thereto;

the Vβ region comprises a complementarity determining region 3 (CDR-3) set forth in any of SEQ ID NOs: 703, 721, 736, 753, 769, 782, 794, 809, 825, 840, 852, 864, 876, 888, 902, 919, 932, 946, 958, 970, 982, 994, or 1010 or a sequence that exhibits at least 60%, 65%, 70%, 75%, 80%, 85%, 90% or 95% sequence identity thereto.

252. The TCR or antigen-binding fragment thereof of any of embodiments 246-251, wherein the Vα region comprises:

a complementarity determining region 1 (CDR-1) comprising the amino acid sequence X$_1$X$_2$X$_3$X$_4$X$_5$X$_6$ (SEQ ID NO: 1191), wherein X$_1$ is N, S, D, T, or V; X$_2$ is 5, V, R, T, or I; X$_3$ is M, F, G, S, N, A, L, V, or P; X$_4$ is F, S, N, A, or null; X$_5$ is D, S, Q, Y, N, V, T, or P; and X$_6$ is Y, S, R, N, G, or T; and/or a complementarity determining region 2 (CDR-2) comprising the amino acid sequence X$_1$X$_2$X$_3$X$_4$X$_5$X$_6$X$_7$X$_8$ (SEQ ID NO: 1192), wherein X$_1$ is I, V, L, G, N, T, Y, or M; X$_2$ is 5, V, Y, L, P, F, I, or T; X$_3$ is S, Y, K, L, T, or F; X$_4$ is I, G, N, A, S, or null; X$_5$ is S, D, or null; X$_6$ is K, G, N, S, D, T, or E; X$_7$ is D, E, G, A, K, L, or N; and X$_8$ is K, V, D, P, N, T, L, or M.

253. The TCR or antigen-binding fragment thereof of any of embodiments 246-252, wherein the Vβ region comprises:

a complementarity determining region 1 (CDR-1) comprising the amino acid sequence SX$_2$X$_3$X$_4$X$_5$ (SEQ ID NO:1203), wherein X$_2$ is G, or N; X$_3$ is H, or D; X$_4$ is T, L, N, or V; and X$_5$ is A, S, Y, or T; and/or a complementarity determining region 2 (CDR-2) comprising the amino acid sequence X$_1$X$_2$X$_3$X$_4$X$_5$X$_6$ (SEQ ID NO:1204), wherein X$_1$ is F, or Y; X$_2$ is Q, Y, or N; X$_3$ is G, N, R, or Y; X$_4$ is N, G, E, or T; X$_5$ is S, E, A, or G; and X$_6$ is A, E, I, or Q.

254. The TCR or antigen-binding fragment thereof of any of embodiments 246-8, wherein the TCR or antigen-binding fragment thereof binds to or recognizes a peptide epitope of human papillomavirus (HPV) 16 E7 in the context of an MHC molecule, the peptide epitope is or comprises E7(11-19) YMLDLQPET (SEQ ID NO:236).

255. The TCR or antigen-binding fragment of any of embodiments 246-254, wherein:

the Vα region comprises a complementarity determining region 3 (CDR-3) comprising the amino acid sequence set forth in any of SEQ ID NOs: 694, 712, 729, 744, 762, 776, 788, 802, 818, 832, 846, 858, 870, 882, 896, 911, 926, 940, 952, 964, 976, 988 or 1002, or a CDR3 contained within the amino acid sequence set forth in any of SEQ ID NOs: 691, 709, 726, 741, 759, 775, 787, 799, 815, 830, 845, 857, 869, 881, 895, 908, 925, 937, 951, 963, 975, 987 or 999; and/or the Vβ region comprises a complementarity determining region 3 (CDR-3) comprising an amino acid sequence set forth in any of SEQ ID NOs: 703, 721, 736, 753, 769, 782, 794, 809, 825, 840, 852, 864, 876, 888, 902, 919, 932, 946, 958, 970, 982, 994, or 1010 or a CDR3 contained within the amino acid sequence set forth in any of SEQ ID NOs: 700, 718, 735, 750, 768, 781, 793, 808, 824, 839, 851, 863, 875, 887, 901, 917, 931, 945, 957, 969, 981, 993 or 1008.

256. The TCR or antigen-binding fragment thereof of any of embodiments 246-255, wherein the Vα region further comprises:

a complementarity determining region 1 (CDR-1) comprising an amino acid sequence set forth in any of SEQ ID NOs: 692, 710, 727, 742, 760, 171, 800, 816, 570, 909, 938, 151, or 1000; and/or a complementarity determining region 2 (CDR-2) comprising an amino acid sequence set forth in any of SEQ ID NOs: 693, 711, 728, 743, 761, 172, 801, 817, 831, 833, 571, 910, 939, 152, or 1001.

257. The TCR or antigen-binding fragment thereof of any of embodiments 246-256, wherein the Vβ region comprises:

a complementarity determining region 1 (CDR-1) comprising the amino acid sequence set forth in any of SEQ ID NOs: 701, 719, 154, 751 or 139; and/or a complementarity determining region 2 (CDR-2) comprising the amino acid sequence set forth in any of SEQ ID NOs: 702, 720, 155, 752, 140 or 918.

258. The TCR or antigen-binding fragment thereof of any of embodiments 246-257, wherein:

the Vα region comprises a CDR-1, CDR-2, and CDR-3, comprising the amino acid sequences of SEQ ID NOs: 692, 693, and 694, respectively, and the Vβ region comprises a CDR-1, CDR-2, and CDR-3, comprising the amino acid sequences of SEQ ID NOs: 701, 702 and 703, respectively;

the Vα region comprises a CDR-1, CDR-2, and CDR-3, comprising the amino acid sequences of SEQ ID NOs: 710, 711, and 712, respectively, and the Vβ region comprises a CDR-1, CDR-2, and CDR-3, comprising the amino acid sequences of SEQ ID NOs: 719, 720 and 721, respectively;

the Vα region comprises a CDR-1, CDR-2, and CDR-3, comprising the amino acid sequences of SEQ ID NOs: 727, 728 and 729, respectively, and the Vβ region comprises a CDR-1, CDR-2, and CDR-3, comprising the amino acid sequences of SEQ ID NOs: 154, 155 and 736, respectively;

the Vα region comprises a CDR-1, CDR-2, and CDR-3, comprising the amino acid sequences of SEQ ID NOs: 742, 743 and 744, respectively, and the Vβ region comprises a CDR-1, CDR-2, and CDR-3, comprising the amino acid sequences of SEQ ID NOs: 751, 752 and 753, respectively;

the Vα region comprises a CDR-1, CDR-2, and CDR-3, comprising the amino acid sequences of SEQ ID NOs: 760, 761 and 762, respectively, and the Vβ region comprises a CDR-1, CDR-2, and CDR-3, comprising the amino acid sequences of SEQ ID NOs: 719, 720 and 769, respectively;

the Vα region comprises a CDR-1, CDR-2, and CDR-3, comprising the amino acid sequences of SEQ ID NOs: 171, 172 and 776, respectively, and the Vβ region comprises a CDR-1, CDR-2, and CDR-3, comprising the amino acid sequences of SEQ ID NOs: 154, 155 and 782, respectively;

the Vα region comprises a CDR-1, CDR-2, and CDR-3, comprising the amino acid sequences of SEQ ID NOs: 742, 743 and 788, respectively, and the Vβ region comprises a CDR-1, CDR-2, and CDR-3, comprising the amino acid sequences of SEQ ID NOs: 139, 140 and 794, respectively;

the Vα region comprises a CDR-1, CDR-2, and CDR-3, comprising the amino acid sequences of SEQ ID NOs: 800, 801 and 802, respectively, and the Vβ region comprises a CDR-1, CDR-2, and CDR-3, comprising the amino acid sequences of SEQ ID NOs: 751, 752 and 809, respectively;

the Vα region comprises a CDR-1, CDR-2, and CDR-3, comprising the amino acid sequences of SEQ ID NOs: 816, 817 and 818, respectively, and the Vβ region comprises a CDR-1, CDR-2, and CDR-3, comprising the amino acid sequences of SEQ ID NOs: 154, 155 and 825, respectively;

the Vα region comprises a CDR-1, CDR-2, and CDR-3, comprising the amino acid sequences of SEQ ID NOs: 816, 831 and 832, respectively, and the Vβ region comprises a CDR-1, CDR-2, and CDR-3, comprising the amino acid sequences of SEQ ID NOs: 154, 155 and 840, respectively;

the Vα region comprises a CDR-1, CDR-2, and CDR-3, comprising the amino acid sequences of SEQ ID NOs: 171, 172 and 846, respectively, and the Vβ region comprises a CDR-1, CDR-2, and CDR-3, comprising the amino acid sequences of SEQ ID NOs: 154, 155 and 852, respectively;

the Vα region comprises a CDR-1, CDR-2, and CDR-3, comprising the amino acid sequences of SEQ ID NOs: 816, 833 and 858, respectively, and the Vβ region comprises a CDR-1, CDR-2, and CDR-3, comprising the amino acid sequences of SEQ ID NOs: 154, 155 and 864, respectively;

the Vα region comprises a CDR-1, CDR-2, and CDR-3, comprising the amino acid sequences of SEQ ID NOs: 727, 728 and 870, respectively, and the Vβ region comprises a CDR-1, CDR-2, and CDR-3, comprising the amino acid sequences of SEQ ID NOs: 154, 155 and 876, respectively;

the Vα region comprises a CDR-1, CDR-2, and CDR-3, comprising the amino acid sequences of SEQ ID NOs: 570, 571 and 882, respectively, and the Vβ region comprises a CDR-1, CDR-2, and CDR-3, comprising the amino acid sequences of SEQ ID NOs: 719, 720 and 888, respectively;

the Vα region comprises a CDR-1, CDR-2, and CDR-3, comprising the amino acid sequences of SEQ ID NOs: 816, 817 and 896, respectively, and the Vβ region comprises a CDR-1, CDR-2, and CDR-3, comprising the amino acid sequences of SEQ ID NOs: 701, 702 and 902, respectively;

the Vα region comprises a CDR-1, CDR-2, and CDR-3, comprising the amino acid sequences of SEQ ID NOs: 909, 910 and 911, respectively, and the Vβ region comprises a CDR-1, CDR-2, and CDR-3, comprising the amino acid sequences of SEQ ID NOs: 701, 702 and 919, respectively;

the Vα region comprises a CDR-1, CDR-2, and CDR-3, comprising the amino acid sequences of SEQ ID NOs: 727, 728 and 926, respectively, and the Vβ region comprises a CDR-1, CDR-2, and CDR-3, comprising the amino acid sequences of SEQ ID NOs: 154, 155 and 932, respectively;

the Vα region comprises a CDR-1, CDR-2, and CDR-3, comprising the amino acid sequences of SEQ ID NOs: 938, 939 and 940, respectively, and the Vβ region comprises a CDR-1, CDR-2, and CDR-3, comprising the amino acid sequences of SEQ ID NOs: 154, 155 and 946, respectively;

the Vα region comprises a CDR-1, CDR-2, and CDR-3, comprising the amino acid sequences of SEQ ID NOs: 727, 728 and 952, respectively, and the Vβ region comprises a CDR-1, CDR-2, and CDR-3, comprising the amino acid sequences of SEQ ID NOs: 154, 155 and 958, respectively;

the Vα region comprises a CDR-1, CDR-2, and CDR-3, comprising the amino acid sequences of SEQ ID NOs: 151, 152 and 964, respectively, and the Vβ region comprises a CDR-1, CDR-2, and CDR-3, comprising the amino acid sequences of SEQ ID NOs: 719, 720 and 970, respectively;

the Vα region comprises a CDR-1, CDR-2, and CDR-3, comprising the amino acid sequences of SEQ ID NOs: 727, 728 and 976, respectively, and the Vβ region comprises a CDR-1, CDR-2, and CDR-3, comprising the amino acid sequences of SEQ ID NOs: 154, 155 and 982, respectively;

the Vα region comprises a CDR-1, CDR-2, and CDR-3, comprising the amino acid sequences of SEQ ID NOs: 710, 711 and 988, respectively, and the Vβ region comprises a CDR-1, CDR-2, and CDR-3, comprising the amino acid sequences of SEQ ID NOs: 719, 729 and 994, respectively;

the Vα region comprises a CDR-1, CDR-2, and CDR-3, comprising the amino acid sequences of SEQ ID NOs: 1000, 1001 and 1002, respectively, and the Vβ region comprises a CDR-1, CDR-2, and CDR-3, comprising the amino acid sequences of SEQ ID NOs: 139, 1009 and 1010, respectively;

259. The TCR or antigen-binding fragment thereof of any of embodiments 246-258, wherein:

the Vα region comprises a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 691, 709, 726, 741, 759, 775, 787, 799, 815, 830, 845, 857, 869, 881, 895, 908, 925, 937, 951, 963, 975, 987 or 999; and/or the Vβ region comprises a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 700, 718, 735, 750, 768, 781, 793, 808, 824, 839, 851, 863, 875, 887, 901, 917, 931, 945, 957, 969, 981, 993 or 1008.

260. The TCR or antigen-binding fragment thereof of any of embodiments 246-259, wherein:

the Vα and Vβ regions comprise the amino acid sequences of SEQ ID NOs: 691 and 700, respectively;

the Vα and Vβ regions comprise the amino acid sequences of SEQ ID NOs: 709 and 718, respectively;

the Vα and Vβ regions comprise the amino acid sequences of SEQ ID NOs:726 and 735, respectively;

the Vα and Vβ regions comprise the amino acid sequences of SEQ ID NOs:741 and 750, respectively;

the Vα and Vβ regions comprise the amino acid sequences of SEQ ID NOs:759 and 768, respectively;

the Vα and Vβ regions comprise the amino acid sequences of SEQ ID NOs:775 and 781, respectively;

the Vα and Vβ regions comprise the amino acid sequences of SEQ ID NOs:787 and 793, respectively;

the Vα and Vβ regions comprise the amino acid sequences of SEQ ID NOs:799 and 808, respectively;

the Vα and Vβ regions comprise the amino acid sequences of SEQ ID NOs:815 and 824, respectively;

the Vα and Vβ regions comprise the amino acid sequences of SEQ ID NOs:830 and 839, respectively;

the Vα and Vβ regions comprise the amino acid sequences of SEQ ID NOs:845 and 851, respectively;

the Vα and Vβ regions comprise the amino acid sequences of SEQ ID NOs:857 and 863, respectively;

the Vα and Vβ regions comprise the amino acid sequences of SEQ ID NOs:869 and 875, respectively;

the Vα and Vβ regions comprise the amino acid sequences of SEQ ID NOs:881 and 887, respectively;

the Vα and Vβ regions comprise the amino acid sequences of SEQ ID NOs:895 and 901, respectively;

the Vα and Vβ regions comprise the amino acid sequences of SEQ ID NOs:908 and 917, respectively;

the Vα and Vβ regions comprise the amino acid sequences of SEQ ID NOs:925 and 931, respectively;

the Vα and Vβ regions comprise the amino acid sequences of SEQ ID NOs:937 and 945, respectively;

the Vα and Vβ regions comprise the amino acid sequences of SEQ ID NOs:951 and 957, respectively;

the Vα and Vβ regions comprise the amino acid sequences of SEQ ID NOs:963 and 969, respectively;

the Vα and Vβ regions comprise the amino acid sequences of SEQ ID NOs:975 and 981, respectively;

the Vα and Vβ regions comprise the amino acid sequences of SEQ ID NOs:987 and 993, respectively;

the Vα and Vβ regions comprise the amino acid sequences of SEQ ID NOs:999 and 1008, respectively.

261. The TCR or antigen-binding fragment thereof of any of embodiments 246-260, wherein the alpha chain further comprises an alpha constant (Cα) region and/or the beta chain further comprises a beta constant (Cβ) region.

262. The TCR or antigen-binding fragment thereof of embodiment 261, wherein the Cα and Cβ regions are mouse constant regions.

263. The TCR or antigen-binding fragment thereof of embodiment 261 or embodiment 262, wherein:

the Cα region comprises the amino acid sequence set forth in SEQ ID NO: 262, 833, 1012, 1014, 1015, 1017, 1018, or a sequence of amino acids that has at least 90% sequence identity thereto; and/or the Cβ region comprises the amino acid sequence set forth in SEQ ID NO: 263, 1013 or 1016 or a sequence of amino acids that has at least 90% sequence identity thereto.

264. The TCR or antigen-binding fragment thereof of embodiment 261, wherein the Cα and Cβ regions are human constant regions.

265. The TCR or antigen-binding fragment thereof of embodiment 261 or embodiment 19, wherein:

the Cα region comprises the amino acid sequence set forth in any of SEQ ID NOs: 212, 213, 215, 217, 218, 220 or 524, or a sequence of amino acids that has at least 90% sequence identity thereto; and/or the Cβ region comprises the amino acid sequence set forth in any of SEQ ID NOs: 214, 216, 631 or 889, or a sequence of amino acids that has at least 90% sequence identity thereto.

266. The TCR or antigen-binding fragment thereof of any of embodiments 246-265, wherein:

a) the alpha chain comprises:

the amino acid sequence set forth in any of SEQ ID NOs: 687, 705, 722, 737, 755, 771, 783, 795, 811, 826, 841, 853, 865, 877, 891, 904, 921, 933, 947, 959, 971, 983, 995, a sequence of amino acids that has at least 90% sequence identity thereto; or the amino acid sequence encoded by the nucleotide sequence set forth in any of SEQ ID NOs: 1049, 1051, 1055, 1057, 1059, 1061, 1063, 1065, 1067, 1069, 1071, 1073, 1075, 1077, 1079, 1081, 1083, 1085, 1087, 1089, 1091, or a nucleotide sequence that has at least 90% sequence identity thereto; and/or the beta chain comprises:

the amino acid sequence set forth in any of SEQ ID NOs: 696, 714, 731, 746, 764, 777, 789, 804, 820, 835, 847, 859, 871, 883, 897, 913, 927, 941, 953, 965, 977, 989, or 1004, a sequence of amino acids that has at least 90% sequence identity thereto; or the amino acid sequence encoded by the nucleotide sequence set forth in SEQ ID NOS: 1050, 1052, 1056, 1058, 1060, 1062, 1064, 1066, 1068, 1070, 1072, 1074, 1076, 1078, 1080, 1082, 1084, 1086, 1088, 1090 or 1092, or a nucleotide sequence that has at least 90% sequence identity thereto.

267. The TCR or antigen-binding fragment thereof of any of embodiments 246-265, wherein:

the alpha and beta chains comprise the amino acid sequences of SEQ ID NOs: 687 and 696, respectively;

the alpha and beta chains comprise the amino acid sequences of SEQ ID NOs: 705 and 714, respectively;

the alpha and beta chains comprise the amino acid sequences of SEQ ID NOs: 722 and 731, respectively;

the alpha and beta chains comprise the amino acid sequences of SEQ ID NOs: 737 and 746, respectively;

the alpha and beta chains comprise the amino acid sequences of SEQ ID NOs: 755 and 764, respectively;

the alpha and beta chains comprise the amino acid sequences of SEQ ID NOs: 771 and 777, respectively;

the alpha and beta chains comprise the amino acid sequences of SEQ ID NOs: 783 and 789, respectively;

the alpha and beta chains comprise the amino acid sequences of SEQ ID NOs: 795 and 804, respectively;

the alpha and beta chains comprise the amino acid sequences of SEQ ID NOs: 811 and 820, respectively;

the alpha and beta chains comprise the amino acid sequences of SEQ ID NOs: 826 and 835, respectively;

the alpha and beta chains comprise the amino acid sequences of SEQ ID NOs: 841 and 847, respectively;

the alpha and beta chains comprise the amino acid sequences of SEQ ID NOs: 853 and 859, respectively;

the alpha and beta chains comprise the amino acid sequences of SEQ ID NOs: 865 and 871, respectively;

the alpha and beta chains comprise the amino acid sequences of SEQ ID NOs: 877 and 883, respectively;

the alpha and beta chains comprise the amino acid sequences of SEQ ID NOs: 891 and 897, respectively;

the alpha and beta chains comprise the amino acid sequences of SEQ ID NOs: 904 and 913, respectively;

the alpha and beta chains comprise the amino acid sequences of SEQ ID NOs: 921 and 927, respectively;

the alpha and beta chains comprise the amino acid sequences of SEQ ID NOs: 933 and 941, respectively;

the alpha and beta chains comprise the amino acid sequences of SEQ ID NOs: 947 and 953, respectively;

the alpha and beta chains comprise the amino acid sequences of SEQ ID NOs: 959 and 965, respectively;

the alpha and beta chains comprise the amino acid sequences of SEQ ID NOs: 971 and 977, respectively;

the alpha and beta chains comprise the amino acid sequences of SEQ ID NOs: 983 and 989, respectively; or the alpha and beta chains comprise the amino acid sequences of SEQ ID NOs: 995 and 1004, respectively.

268. The TCR or antigen-binding fragment thereof of any of embodiments 246-264, wherein the TCR or antigen-binding fragment comprises one or more modifications in the α chain and/or β chain such that when the TCR or antigen-binding fragment thereof is expressed in a cell, the frequency of mispairing between the TCR α chain and β chain and an endogenous TCR α chain and β chain is reduced, the expression of the TCR α chain and β chain is increased and/or the stability of the TCR α chain and β chain is increased, each compared to expression in a cell of the TCR or antigen-binding fragment thereof not containing the one or more modifications.

269. The TCR or antigen-binding fragment thereof of embodiment 268, wherein the one or more modifications is a replacement, deletion, or insertion of one or more amino acids in the Cα region and/or the Cβ region.

270. The TCR or antigen-binding fragment thereof of embodiment 268 or embodiment 269, wherein the one or more modifications comprise replacement(s) to introduce one or more cysteine residues that are capable of forming one or more non-native disulfide bridges between the alpha chain and beta chain.

271. The TCR or antigen-binding fragment thereof of any of embodiments 246-16, 19 and 23-25, comprising a Cα region comprising a cysteine at a position corresponding to position 48 with numbering as set forth in SEQ ID NO: 212, 213, 217, 218, or 524 or at a position corresponding to position 49 with numbering as set forth in SEQ ID NO: 215 or 220; and/or a Cβ region comprising a cysteine at a position corresponding to position 57 with numbering as set forth in SEQ ID NO: 214 or 216 or at a position corresponding to position 58 with numbering as set forth in SEQ ID NO: 631 or 889.

272. The TCR or antigen-binding fragment thereof of any of embodiments 261, 264, and 268-271, wherein:

the Cα region comprises the amino acid sequence set forth in any of SEQ ID NOs: 196, 198, 200, 201, 203, or 525, or a sequence of amino acids that has at least 90% sequence identity thereto comprising one or more cysteine residues capable of forming a non-native disulfide bond with the beta chain; and/or the Cβ region comprises the amino acid sequence set forth in any of SEQ ID NOs: 197, 199, 632, or 890 or a sequence of amino acids that has at least 90% sequence identity thereto that contains one or more cysteine residues capable of forming a non-native disulfide bond with the alpha chain.

273. The TCR or antigen-binding fragment thereof of any of embodiments 246-272, wherein the TCR or antigen-binding fragment thereof is encoded by a nucleotide sequence that has been codon-optimized.

274. The TCR or antigen-binding fragment thereof of any of embodiments 246-264 and 268-273, wherein:

a) the alpha chain comprises:

the amino acid sequence set forth in any of SEQ ID NOs: 688, 706, 723, 738, 756, 772, 784, 796, 812, 827, 842, 854, 866, 878, 892, 905, 922, 934, 948, 960, 972, 984 or 996, a sequence of amino acids that has at least 90% sequence identity thereto; or the amino acid sequence encoded by the nucleotide sequence set forth in any of SEQ ID NOs: 1129, 1131, 1133, 1135, 1137, 1139, 1141, 1143, 1145, 1147, 1149, 1151, 1153, 1155, 1157, 1159, 1161, 1163, 1165, 1167, 1169, 1171 or 1173, or a nucleotide sequence that has at least 90% sequence identity thereto; and/or the beta chain comprises:

the amino acid sequence set forth in any of SEQ ID NOs: 697, 715, 732, 747, 765, 778, 790, 805, 821, 836, 848, 860, 872, 884, 898, 914, 928, 942, 954, 966, 978, 990 or 1005, a sequence of amino acids that has at least 90% sequence identity thereto; or the amino acid sequence encoded by the nucleotide sequence set forth in SEQ ID NOS: 1130, 1132, 1134, 1136, 1138, 1140, 1142, 1144, 1146, 1148, 1150, 1152, 1154, 1156, 1158, 1160, 1162, 1164, 1166, 1168, 1170, 1172 or 1174, or a nucleotide sequence that has at least 90% sequence identity thereto.

275. The TCR or antigen-binding fragment thereof of any of embodiments 246-264 and 268-274, wherein:

the alpha and beta chains comprise the amino acid sequences of SEQ ID NOs: 688 and 697, respectively;
the alpha and beta chains comprise the amino acid sequences of SEQ ID NOs: 706 and 715, respectively;
the alpha and beta chains comprise the amino acid sequences of SEQ ID NOs: 723 and 732, respectively;
the alpha and beta chains comprise the amino acid sequences of SEQ ID NOs: 738 and 747, respectively;
the alpha and beta chains comprise the amino acid sequences of SEQ ID NOs: 756 and 765, respectively;
the alpha and beta chains comprise the amino acid sequences of SEQ ID NOs: 772 and 778, respectively;
the alpha and beta chains comprise the amino acid sequences of SEQ ID NOs: 784 and 790, respectively;
the alpha and beta chains comprise the amino acid sequences of SEQ ID NOs: 796 and 805, respectively;
the alpha and beta chains comprise the amino acid sequences of SEQ ID NOs: 812 and 821, respectively;
the alpha and beta chains comprise the amino acid sequences of SEQ ID NOs: 827 and 836, respectively;
the alpha and beta chains comprise the amino acid sequences of SEQ ID NOs: 842 and 848, respectively;
the alpha and beta chains comprise the amino acid sequences of SEQ ID NOs: 854 and 860, respectively;
the alpha and beta chains comprise the amino acid sequences of SEQ ID NOs: 866 and 872, respectively;
the alpha and beta chains comprise the amino acid sequences of SEQ ID NOs: 878 and 884, respectively;
the alpha and beta chains comprise the amino acid sequences of SEQ ID NOs: 892 and 898, respectively;
the alpha and beta chains comprise the amino acid sequences of SEQ ID NOs: 905 and 914, respectively;
the alpha and beta chains comprise the amino acid sequences of SEQ ID NOs: 922 and 928, respectively;
the alpha and beta chains comprise the amino acid sequences of SEQ ID NOs: 934 and 942, respectively;
the alpha and beta chains comprise the amino acid sequences of SEQ ID NOs: 948 and 954, respectively;
the alpha and beta chains comprise the amino acid sequences of SEQ ID NOs: 960 and 966, respectively;
the alpha and beta chains comprise the amino acid sequences of SEQ ID NOs: 972 and 978, respectively;
the alpha and beta chains comprise the amino acid sequences of SEQ ID NOs: 984 and 990, respectively; or
the alpha and beta chains comprise the amino acid sequences of SEQ ID NOs: 996 and 1005, respectively.

276. The TCR or antigen-binding fragment thereof of any of embodiments 1-30, wherein the alpha and/or beta chain further comprises a signal peptide.

277. The TCR or antigen-binding fragment thereof of embodiment 31, wherein:

the alpha chain comprises the signal peptide comprising the amino acid sequence set forth in any of SEQ ID NOs: 181, 184, 187, 189, 190, 192, 193, 310, 311; and/or the beta chain comprises the signal peptide comprising the amino acid sequence set forth in any of SEQ ID NOs: 182, 185, 186, 188, 191, or 194.

278. The TCR or antigen-binding fragment thereof of any of embodiments 246-277, that is isolated or purified or is recombinant.

279. The TCR or antigen-binding fragment thereof of any of embodiments 246-279, that is human.

280. The TCR or antigen-binding fragment thereof of any of embodiments 246-279, that is monoclonal.

281. The TCR or antigen-binding fragment thereof of any of embodiments 246-280, wherein the TCR or antigen-binding fragment thereof is single chain.

282. The TCR or antigen-binding fragment thereof of any of embodiments 246-281, wherein the TCR or antigen-binding fragment thereof comprises two chains.

283. The TCR or antigen-binding fragment thereof of any of embodiments 246-282, wherein the antigen-specificity is at least partially CD8-independent.

284. The TCR or antigen-binding fragment of any of embodiments 254-283 wherein the MHC molecule is an HLA-A2 molecule.

285. A nucleic acid molecule encoding the TCR or antigen-binding fragment thereof of any of embodiments 246-284, or an alpha or beta chain thereof.

286. The nucleic acid molecule of embodiment 285, comprising a nucleotide sequence encoding an alpha chain and/or a nucleotide sequence encoding a beta chain, wherein:

the nucleotide sequence encoding an alpha chain comprises the sequence set forth in any of SEQ ID NOS: 1049, 1051, 1055, 1057, 1059, 1061, 1063, 1065, 1067, 1069, 1071, 1073, 1075, 1077, 1079, 1081, 1083, 1085, 1087, 1089, 1091, or a nucleotide sequence that has at least 90% sequence identity thereto;

the nucleotide sequence encoding a beta chain comprises the sequence set forth in SEQ ID NOS: 1050, 1052, 1056, 1058, 1060, 1062, 1064, 1066, 1068, 1070, 1072, 1074, 1076, 1078, 1080, 1082, 1084, 1086, 1088, 1090 or 1092, or a nucleotide sequence that has at least 90% sequence identity thereto.

287. The nucleic acid molecule of embodiment 285, wherein the nucleotide sequence is codon-optimized.

288. The nucleic acid molecule of embodiment 285 or embodiment 287, comprising a nucleotide sequence encoding an alpha chain and/or a nucleotide sequence encoding a beta chain, wherein:

the nucleotide sequence encoding an alpha chain comprises the sequence to set forth in any of SEQ ID NOS: 1129, 1131, 1133, 1135, 1137, 1139, 1141, 1143, 1145, 1147, 1149, 1151, 1153, 1155, 1157, 1159, 1161, 1163, 1165, 1167, 1169, 1171 or 1173, or a nucleotide sequence that has at least 90% sequence identity thereto;

the nucleotide sequence encoding a beta chain comprises the sequence set forth in SEQ ID NOS: 1130, 1132, 1134, 1136, 1138, 1140, 1142, 1144, 1146, 1148, 1150, 1152, 1154, 1156, 1158, 1160, 1162, 1164, 1166, 1168, 1170, 1172 or 1174, or a nucleotide sequence that has at least 90% sequence identity thereto.

289. The nucleic acid molecule of any of embodiments 285-288, wherein the nucleotide sequence encoding the alpha chain and the nucleotide sequence encoding the beta chain are separated by a peptide sequence that causes ribosome skipping.

290. The nucleic acid molecule of embodiment 289, wherein the peptide that causes ribosome skipping is a P2A or T2A peptide and/or comprises the sequence of amino acids set forth in SEQ ID NO: 204 or 211.

291. The nucleic acid of any of embodiments 285-290, comprising the nucleotide sequence set forth in any of SEQ ID NOs: 448, 449, 450, 451, 452, 453, 454, 455, 456, 457, 458, 459, 460, 461, 462, 463, 464, 465, 466, 467, 468, 469 or 470, or a nucleotide sequence having at least 90% sequence identity thereto.

292. A T cell receptor (TCR) or antigen-binding fragment thereof, comprising an alpha chain comprising a variable alpha (Vα) region and a beta chain comprising a variable beta (Vβ) region, wherein:

the Vα region comprises the amino acid sequence set forth in any of SEQ ID NOs: 477, 492, 504, 510, 522, 536, 554, 569, 587, 599, 611, 623, 637, 649, 661 or 676, or an amino acid sequence that has at least 90%, 91%, 92%, 93%, 94%, 95%, 96%, 97%, 98%, or 99% sequence identity thereto; and/or the Vβ region comprises the amino acid sequence set forth in any of SEQ ID NOs: 483, 498, 498, 516, 530, 545, 560, 578, 593, 605, 617, 629, 643, 655, 667 or 685, or an amino acid sequence that has at least 90%, 91%, 92%, 93%, 94%, 95%, 96%, 97%, 98%, or 99% sequence identity thereto.

293. The TCR or antigen-binding fragment thereof of embodiment 292, wherein the Vα region comprises a complementarity determining region 3 (CDR-3) comprising the amino acid sequence $AX_2RX_4AX_6NNDMR$, wherein $X_2$ is V, or M; $X_4$ is P, or D; and $X_6$ is N, or R.

294. The TCR or antigen-binding fragment thereof of embodiment 292 or embodiment 293, wherein:

the Vβ region comprises a complementarity determining region 3 (CDR-3) comprising the amino acid sequence $ASSX_4WGX_7SNQPX_{12}H$, wherein $X_4$ is L, F, or P; $X_7$ is R, or Q; and $X_{12}$ is Q, or L; or the Vβ region comprises a complementarity determining region 3 (CDR-3) comprising the amino acid sequence $ASSX_4X_5X_6X_7X_8SGNTIY$, wherein $X_4$ is L, or R; $X_5$ is W, or Q; $X_6$ is G, or P; $X_7$ is R, or S; and $X_8$ is S, or null.

295. A T cell receptor (TCR) or antigen-binding fragment thereof, comprising an alpha chain comprising a variable alpha (Vα) region and a beta chain comprising a variable beta (Vβ) region, wherein the Vα region comprises a complementarity determining region 3 (CDR-3) comprising the amino acid sequence $AX_2RX_4AX_6NNDMR$, wherein $X_2$ is V, or M; $X_4$ is P, or D; and $X_6$ is N, or R.

296. A T cell receptor (TCR) or antigen-binding fragment thereof, comprising an alpha chain comprising a variable alpha (Vα) region and a beta chain comprising a variable beta (Vβ) region, wherein:

the Vβ region comprises a complementarity determining region 3 (CDR-3) comprising the amino acid sequence $ASSX_4WGX_7SNQPX_{12}H$, wherein $X_4$ is L, F, or P; $X_7$ is R, or Q; and $X_{12}$ is Q, or L; or the Vβ region comprises a complementarity determining region 3 (CDR-3) comprising the amino acid sequence $ASSX_4X_5X_6X_7X_8SGNTIY$, wherein $X_4$ is L, or R; $X_5$ is W, or Q; $X_6$ is G, or P; $X_7$ is R, or S; and $X_8$ is S, or null.

297. A T cell receptor (TCR) or antigen-binding fragment thereof, comprising an alpha chain comprising a variable alpha (Vα) region and a beta chain comprising a variable beta (Vβ) region, wherein:

the Vα region comprises a complementarity determining region 3 (CDR-3) set forth in any of SEQ ID NOs: 478, 493, 505, 511, 523, 539, 555, 572, 588, 600, 612, 624, 638, 650, 662 or 679, or a sequence that exhibits at least 60%, 65%, 70%, 75%, 80%, 85%, 90% or 95% sequence identity thereto;

the Vβ region comprises a complementarity determining region 3 (CDR-3) set forth in any of SEQ ID NOs: 486, 499, 517, 531, 548, 563, 581, 594, 606, 618, 630, 644, 656, 670 or 686, or a sequence that exhibits at least 60%, 65%, 70%, 75%, 80%, 85%, 90% or 95% sequence identity thereto.

298. The TCR or antigen-binding fragment thereof of any of embodiments 292-297, wherein the Vα region comprises:

a complementarity determining region 1 (CDR-1) comprising the amino acid sequence $X_1X_2X_3X_4X_5X_6$ (SEQ ID NO: 1191), wherein $X_1$ is N, S, D, T, or V; $X_2$ is 5, V, R, T, or I; $X_3$ is M, F, G, S, N, A, L, V, or P; $X_4$ is F, S, N, A, or null; $X_5$ is D, S, Q, Y, N, V, T, or P; and $X_6$ is Y, S, R, N, G, or T; and/or a complementarity determining region 2 (CDR-2) comprising the amino acid sequence $X_1X_2X_3X_4X_5X_6X_7X_8$ (SEQ ID NO:1192), wherein $X_1$ is I, V, L, G, N, T, Y, or M; $X_2$ is 5, V, Y, L, P, F, I, or T; $X_3$ is S, Y, K, L, T, or F; $X_4$ is I, G, N, A, S, or null; $X_5$ is S, D, or null; $X_6$ is K, G, N, S, D, T, or E; $X_7$ is D, E, G, A, K, L, or N; and $X_8$ is K, V, D, P, N, T, L, or M.

299. The TCR or antigen-binding fragment thereof of any of embodiments 292-298, wherein the Vβ region comprises:

a complementarity determining region 1 (CDR-1) comprising the amino acid sequence $SX_2X_3X_4X_5$ (SEQ ID NO:1203), wherein $X_2$ is G, or N; $X_3$ is H, or D; $X_4$ is T, L, N, or V; and $X_5$ is A, S, Y, or T; and/or a complementarity determining region 2 (CDR-2) comprising the amino acid sequence $X_1X_2X_3X_4X_5X_6$ (SEQ ID NO:1204), wherein $X_1$ is F, or Y; $X_2$ is Q, Y, or N; $X_3$ is G, N, R, or Y; $X_4$ is N, G, E, or T; $X_5$ is S, E, A, or G; and $X_6$ is A, E, I, or Q.

300. The TCR or antigen-binding fragment thereof of any of embodiments 292-299, wherein the TCR or antigen-binding fragment thereof binds to or recognizes a peptide epitope of human papillomavirus (HPV) 16 E6 in the context of an MHC molecule, the peptide epitope is or comprises E6(29-38) TIHDIILECV (SEQ ID NO:233).

301. The TCR or antigen-binding fragment of any of embodiments 292-300, wherein:

the Vα region comprises a complementarity determining region 3 (CDR-3) comprising the amino acid sequence set forth in any of SEQ ID NOs: 478, 493, 505, 511, 523, 539, 555, 572, 588, 600, 612, 624, 638, 650, 662 or 679, or a CDR3 contained within the amino acid sequence set forth in any of SEQ ID NOs: 477, 492, 504, 510, 522, 536, 554, 569, 587, 599, 611, 623, 637, 649, 661 or 676; and/or the Vβ region comprises a complementarity determining region 3 (CDR-3) comprising an amino acid sequence set forth in any of SEQ ID NOs: 486, 499, 517, 531, 548, 563, 581, 594, 606, 618, 630, 644, 656, 670 or 686 or a CDR3 contained within the amino acid sequence set forth in any of SEQ ID NOs: 483, 498, 498, 516, 530, 545, 560, 578, 593, 605, 617, 629, 643, 655, 667 or 685.

302. The TCR or antigen-binding fragment thereof of any of embodiments 292-301, wherein the Vα region further comprises:

a complementarity determining region 1 (CDR-1) comprising an amino acid sequence set forth in any of SEQ ID NOs: 136, 161, 165, 537, 570, 142, 171 or 677; and/or a complementarity determining region 2 (CDR-2) comprising an amino acid sequence set forth in any of SEQ ID NOs: 137, 162, 166, 538, 571, 143, 172 or 678.

303. The TCR or antigen-binding fragment thereof of any of embodiments 292-301, wherein the Vβ region comprises:

a complementarity determining region 1 (CDR-1) comprising the amino acid sequence set forth in any of SEQ ID NOs: 484, 148, 546, 561, 579, 168, 668 or 154; and/or a complementarity determining region 2 (CDR-2) comprising the amino acid sequence set forth in any of SEQ ID NOs: 485, 149, 547, 562, 580, 169, 669 or 155.

304. The TCR or antigen-binding fragment thereof of any of embodiments 292-303, wherein:

the Vα region comprises a CDR-1, CDR-2, and CDR-3, comprising the amino acid sequences of SEQ ID NOs: 136, 137 and 478, respectively, and the Vβ region comprises a CDR-1, CDR-2, and CDR-3, comprising the amino acid sequences of SEQ ID NOs: 484, 485 and 486, respectively;

the Vα region comprises a CDR-1, CDR-2, and CDR-3, comprising the amino acid sequences of SEQ ID NOs: 161, 162 and 493, respectively, and the Vβ region comprises a CDR-1, CDR-2, and CDR-3, comprising the amino acid sequences of SEQ ID NOs: 148, 149 and 499, respectively;

the Vα region comprises a CDR-1, CDR-2, and CDR-3, comprising the amino acid sequences of SEQ ID NOs: 165, 166 and 505, respectively, and the Vβ region comprises a CDR-1, CDR-2, and CDR-3, comprising the amino acid sequences of SEQ ID NOs: 148, 149 and 499, respectively;

the Vα region comprises a CDR-1, CDR-2, and CDR-3, comprising the amino acid sequences of SEQ ID NOs: 161, 162 and 511, respectively, and the Vβ region comprises a CDR-1, CDR-2, and CDR-3, comprising the amino acid sequences of SEQ ID NOs: 148, 149 and 517, respectively;

the Vα region comprises a CDR-1, CDR-2, and CDR-3, comprising the amino acid sequences of SEQ ID NOs: 136, 137 and 523, respectively, and the Vβ region comprises a CDR-1, CDR-2, and CDR-3, comprising the amino acid sequences of SEQ ID NOs: 148, 149 and 531, respectively;

the Vα region comprises a CDR-1, CDR-2, and CDR-3, comprising the amino acid sequences of SEQ ID NOs: 537, 538, and 539, respectively, and the Vβ region comprises a CDR-1, CDR-2, and CDR-3, comprising the amino acid sequences of SEQ ID NOs: 546, 547 and 548, respectively;

the Vα region comprises a CDR-1, CDR-2, and CDR-3, comprising the amino acid sequences of SEQ ID NOs: 136, 137 and 555, respectively, and the Vβ region comprises a CDR-1, CDR-2, and CDR-3, comprising the amino acid sequences of SEQ ID NOs: 561, 562 and 563, respectively;

the Vα region comprises a CDR-1, CDR-2, and CDR-3, comprising the amino acid sequences of SEQ ID NOs: 570, 571 and 572, respectively, and the Vβ region comprises a CDR-1, CDR-2, and CDR-3, comprising the amino acid sequences of SEQ ID NOs: 579, 580 and 581, respectively;

the Vα region comprises a CDR-1, CDR-2, and CDR-3, comprising the amino acid sequences of SEQ ID NOs: 136, 137 and 600, respectively, and the Vβ region comprises a CDR-1, CDR-2, and CDR-3, comprising the amino acid sequences of SEQ ID NOs: 148, 149 and 594, respectively;

the Vα region comprises a CDR-1, CDR-2, and CDR-3, comprising the amino acid sequences of SEQ ID NOs: 136, 137 and 600, respectively, and the Vβ region comprises a CDR-1, CDR-2, and CDR-3, comprising the amino acid sequences of SEQ ID NOs: 148, 149 and 606, respectively;

the Vα region comprises a CDR-1, CDR-2, and CDR-3, comprising the amino acid sequences of SEQ ID NOs: 136, 137 and 612, respectively, and the Vβ region comprises a CDR-1, CDR-2, and CDR-3, comprising the amino acid sequences of SEQ ID NOs: 148, 149 and 618, respectively;

the Vα region comprises a CDR-1, CDR-2, and CDR-3, comprising the amino acid sequences of SEQ ID NOs: 136, 137 and 624, respectively, and the Vβ region comprises a CDR-1, CDR-2, and CDR-3, comprising the amino acid sequences of SEQ ID NOs: 168, 169 and 630, respectively;

the Vα region comprises a CDR-1, CDR-2, and CDR-3, comprising the amino acid sequences of SEQ ID NOs: 142, 143 and 638, respectively, and the Vβ region comprises a CDR-1, CDR-2, and CDR-3, comprising the amino acid sequences of SEQ ID NOs: 561, 562 and 644, respectively;

the Vα region comprises a CDR-1, CDR-2, and CDR-3, comprising the amino acid sequences of SEQ ID NOs: 171, 172 and 650, respectively, and the Vβ region comprises a CDR-1, CDR-2, and CDR-3, comprising the amino acid sequences of SEQ ID NOs: 148, 149 and 656, respectively;

the Vα region comprises a CDR-1, CDR-2, and CDR-3, comprising the amino acid sequences of SEQ ID NOs: 136, 137 and 662, respectively, and the Vβ region comprises a CDR-1, CDR-2, and CDR-3, comprising the amino acid sequences of SEQ ID NOs: 668, 669 and 670, respectively; or the Vα region comprises a CDR-1, CDR-2, and CDR-3, comprising the amino acid sequences of SEQ ID NOs: 677, 678 and 679, respectively, and the Vβ region comprises a CDR-1, CDR-2, and CDR-3, comprising the amino acid sequences of SEQ ID NOs: 154, 155 and 686, respectively.

305. The TCR or antigen-binding fragment thereof of any of embodiments 292-304, wherein:

the Vα region comprises a complementarity determining region 1 (CDR-1), a CDR-2, and a CDR-3, respectively comprising the CDR-1, CDR-2, and CDR-3 amino acid sequences contained within a Vα region amino acid sequence set forth in any of SEQ ID NOs: 477, 492, 504, 510, 522, 536, 554, 569, 587, 599, 611, 623, 637, 649, 661 or 676; and/or the Vβ region comprises a complementarity determining region 1 (CDR-1), a CDR-2, and a CDR-3, respectively comprising the CDR-1, CDR-2, and CDR-3 amino acid sequences contained within a Vβ region amino acid sequence set forth in any of SEQ ID NOs: 483, 498, 498, 516, 530, 545, 560, 578, 593, 605, 617, 629, 643, 655, 667 or 685.

306. The TCR or antigen-binding fragment thereof of any of embodiments 292-305, wherein:
the Vα and Vβ regions comprise the amino acid sequences of SEQ ID NOs: 477 and 403, respectively;
the Vα and Vβ regions comprise the amino acid sequences of SEQ ID NOs: 492 and 498, respectively;
the Vα and Vβ regions comprise the amino acid sequences of SEQ ID NOs: 504 and 498, respectively;
the Vα and Vβ regions comprise the amino acid sequences of SEQ ID NOs: 510 and 516, respectively;
the Vα and Vβ regions comprise the amino acid sequences of SEQ ID NOs: 522 and 530, respectively;
the Vα and Vβ regions comprise the amino acid sequences of SEQ ID NOs: 536 and 545, respectively;
the Vα and Vβ regions comprise the amino acid sequences of SEQ ID NOs: 554 and 560, respectively;
the Vα and Vβ regions comprise the amino acid sequences of SEQ ID NOs: 569 and 578, respectively;
the Vα and Vβ regions comprise the amino acid sequences of SEQ ID NOs: 587 and 593, respectively;
the Vα and Vβ regions comprise the amino acid sequences of SEQ ID NOs: 599 and 605, respectively;
the Vα and Vβ regions comprise the amino acid sequences of SEQ ID NOs: 611 and 617, respectively;
the Vα and Vβ regions comprise the amino acid sequences of SEQ ID NOs: 623 and 629, respectively;
the Vα and Vβ regions comprise the amino acid sequences of SEQ ID NOs: 637 and 643, respectively;
the Vα and Vβ regions comprise the amino acid sequences of SEQ ID NOs: 649 and 655, respectively;
the Vα and Vβ regions comprise the amino acid sequences of SEQ ID NOs: 661 and 667, respectively;
the Vα and Vβ regions comprise the amino acid sequences of SEQ ID NOs:676 and 685, respectively.

307. The TCR or antigen-binding fragment thereof of any of embodiments 292-306, wherein the alpha chain further comprises an alpha constant (Cα) region and/or the beta chain further comprises a beta constant (Cβ) region.

308. The TCR or antigen-binding fragment thereof of embodiment 307, wherein the Cα and Cβ regions are mouse constant regions.

309. The TCR or antigen-binding fragment thereof of embodiment 307 or embodiment 308, wherein:
the Cα region comprises the amino acid sequence set forth in SEQ ID NO: 262, 833, 1012, 1014, 1015, 1017, 1018, or a sequence of amino acids that has at least 90% sequence identity thereto; and/or
the Cβ region comprises the amino acid sequence set forth in SEQ ID NO: 263, 1013 or 1016 or a sequence of amino acids that has at least 90% sequence identity thereto.

310. The TCR or antigen-binding fragment thereof of embodiment 307, wherein the Cα and Cβ regions are human constant regions.

311. The TCR or antigen-binding fragment thereof of embodiment 307 or embodiment 310, wherein:
the Cα region comprises the amino acid sequence set forth in any of SEQ ID NOs: 212, 213, 215, 217, 218, 220 or 524, or a sequence of amino acids that has at least 90% sequence identity thereto; and/or
the Cβ region comprises the amino acid sequence set forth in any of SEQ ID NOs: 214, 216, 631 or 889, or a sequence of amino acids that has at least 90% sequence identity thereto.

312. The TCR or antigen-binding fragment thereof of any of embodiments 292-311, wherein:
a) the alpha chain comprises:
the amino acid sequence set forth in any of SEQ ID NOs: 473, 488, 500, 506, 518, 532, 550, 565, 583, 595, 607, 619, 633, 645, 657 or 672, a sequence of amino acids that has at least 90% sequence identity thereto; or the amino acid sequence encoded by the nucleotide sequence set forth in any of SEQ ID NOs: 389, 430, 1019, 1021, 1023, 1025, 1027, 1029, 1031, 1033, 1035, 1037, 1039, 1041, 1043 or 1045, or a nucleotide sequence that has at least 90% sequence identity thereto; and/or
the beta chain comprises:
the amino acid sequence set forth in any of SEQ ID NOs: 479, 494, 494, 512, 526, 541, 556, 574, 589, 601, 613, 625, 639, 651, 663 or 681, a sequence of amino acids that has at least 90% sequence identity thereto; or the amino acid sequence encoded by the nucleotide sequence set forth in SEQ ID NOS: 390, 431, 1020, 1022, 1024, 1026, 1028, 1030, 1032, 1034 1036, 1038, 1040, 1042, 1044 or 1046, or a nucleotide sequence that has at least 90% sequence identity thereto.

313. The TCR or antigen-binding fragment thereof of any of embodiments 292-312, wherein:
the alpha and beta chains comprise the amino acid sequences of SEQ ID NOs: 473 and 479, respectively;
the alpha and beta chains comprise the amino acid sequences of SEQ ID NOs: 488 and 494, respectively;
the alpha and beta chains comprise the amino acid sequences of SEQ ID NOs: 500 and 494, respectively;
the alpha and beta chains comprise the amino acid sequences of SEQ ID NOs: 506 and 512, respectively;
the alpha and beta chains comprise the amino acid sequences of SEQ ID NOs: 518 and 526, respectively;
the alpha and beta chains comprise the amino acid sequences of SEQ ID NOs: 532 and 541, respectively;
the alpha and beta chains comprise the amino acid sequences of SEQ ID NOs: 550 and 556, respectively;
the alpha and beta chains comprise the amino acid sequences of SEQ ID NOs: 565 and 574, respectively;
the alpha and beta chains comprise the amino acid sequences of SEQ ID NOs: 583 and 589, respectively;
the alpha and beta chains comprise the amino acid sequences of SEQ ID NOs: 595 and 601, respectively;
the alpha and beta chains comprise the amino acid sequences of SEQ ID NOs: 607 and 613, respectively;
the alpha and beta chains comprise the amino acid sequences of SEQ ID NOs: 619 and 625, respectively;
the alpha and beta chains comprise the amino acid sequences of SEQ ID NOs: 633 and 639, respectively;
the alpha and beta chains comprise the amino acid sequences of SEQ ID NOs: 645 and 651, respectively;
the alpha and beta chains comprise the amino acid sequences of SEQ ID NOs: 657 and 663, respectively; or
the alpha and beta chains comprise the amino acid sequences of SEQ ID NOs: 672 and 681, respectively.

314. The TCR or antigen-binding fragment thereof of any of embodiments 292-313, wherein the TCR or antigen-binding fragment comprises one or more modifications in the α chain and/or β chain such that when the TCR or antigen-binding fragment thereof is expressed in a cell, the frequency of mispairing between the TCR α chain and β chain and an endogenous TCR α chain and β chain is reduced, the expression of the TCR α chain and β chain is increased and/or the stability of the TCR α chain and β chain is increased, each compared to expression in a cell of the TCR or antigen-binding fragment thereof not containing the one or more modifications.

315. The TCR or antigen-binding fragment thereof of embodiment 314, wherein the one or more modifications is a replacement, deletion, or insertion of one or more amino acids in the Cα region and/or the Cβ region.

316. The TCR or antigen-binding fragment thereof of embodiment 314 or embodiment 315, wherein the one or more modifications comprise replacement(s) to introduce one or more cysteine residues that are capable of forming one or more non-native disulfide bridges between the alpha chain and beta chain.

317. The TCR or antigen-binding fragment thereof of any of embodiments 292-307, 310 and 314-316, comprising a Cα region comprising a cysteine at a position corresponding to position 48 with numbering as set forth in SEQ ID NO: 212, 213, 217, 218, or 524 or at a position corresponding to position 49 with numbering as set forth in SEQ ID NO: 215 or 220; and/or a Cβ region comprising a cysteine at a position corresponding to position 57 with numbering as set forth in SEQ ID NO: 214 or 216 or at a position corresponding to position 58 with numbering as set forth in SEQ ID NO: 631 or 889.

318. The TCR or antigen-binding fragment thereof of any of embodiments 307, 310, and 314-317, wherein:
the Cα region comprises the amino acid sequence set forth in any of SEQ ID NOs: 196, 198, 200, 201, 203, or 525, or a sequence of amino acids that has at least 90% sequence identity thereto comprising one or more cysteine residues capable of forming a non-native disulfide bond with the beta chain; and/or
the Cβ region comprises the amino acid sequence set forth in any of SEQ ID NOs: 197, 199, 632, or 890 or a sequence of amino acids that has at least 90% sequence identity thereto that contains one or more cysteine residues capable of forming a non-native disulfide bond with the alpha chain.

319. The TCR or antigen-binding fragment thereof of any of embodiments 292-318, wherein the TCR or antigen-binding fragment thereof is encoded by a nucleotide sequence that has been codon-optimized.

320. The TCR or antigen-binding fragment thereof of any of embodiments 292-307, 310, and 314-319, wherein:
a) the alpha chain comprises:
the amino acid sequence set forth in any of SEQ ID NOs: 474, 489, 501, 507, 519, 533, 551, 566, 584, 596, 608, 620, 634, 646, 658 or 673, a sequence of amino acids that has at least 90% sequence identity thereto; or the amino acid sequence encoded by the nucleotide sequence set forth in any of SEQ ID NOs: 1097, 1099, 1101, 1103, 1105, 1107, 1109, 1111, 1113, 1115, 1117, 1119, 1121, 1123, 1125 or 1127, or a nucleotide sequence that has at least 90% sequence identity thereto; and/or
the beta chain comprises:
the amino acid sequence set forth in any of SEQ ID NOs: 480, 495, 495, 513, 527, 542, 557, 575, 590, 602, 614, 626, 640, 652, 664 or 682, a sequence of amino acids that has at least 90% sequence identity thereto; or the amino acid sequence encoded by the nucleotide sequence set forth in SEQ ID NOS: 1098, 1100, 1102, 1104, 1106, 1108, 1110, 1112, 1114, 1116, 1118, 1120, 1122, 1124, 1126 or 1128, or a nucleotide sequence that has at least 90% sequence identity thereto.

321. The TCR or antigen-binding fragment thereof of any of embodiments 292-307, 310, and 314-320, wherein:
the alpha and beta chains comprise the amino acid sequences of SEQ ID NOs: 474 and 482, respectively;
the alpha and beta chains comprise the amino acid sequences of SEQ ID NOs: 489 and 497, respectively;
the alpha and beta chains comprise the amino acid sequences of SEQ ID NOs: 501 and 497, respectively;
the alpha and beta chains comprise the amino acid sequences of SEQ ID NOs: 507 and 515, respectively;
the alpha and beta chains comprise the amino acid sequences of SEQ ID NOs: 519 and 529, respectively;
the alpha and beta chains comprise the amino acid sequences of SEQ ID NOs: 533 and 544, respectively;
the alpha and beta chains comprise the amino acid sequences of SEQ ID NOs: 551 and 559, respectively;
the alpha and beta chains comprise the amino acid sequences of SEQ ID NOs: 566 and 577, respectively;
the alpha and beta chains comprise the amino acid sequences of SEQ ID NOs: 584 and 592, respectively;
the alpha and beta chains comprise the amino acid sequences of SEQ ID NOs: 596 and 604, respectively;
the alpha and beta chains comprise the amino acid sequences of SEQ ID NOs: 608 and 616, respectively;
the alpha and beta chains comprise the amino acid sequences of SEQ ID NOs: 620 and 628, respectively;
the alpha and beta chains comprise the amino acid sequences of SEQ ID NOs: 634 and 642, respectively;
the alpha and beta chains comprise the amino acid sequences of SEQ ID NOs: 646 and 654, respectively;
the alpha and beta chains comprise the amino acid sequences of SEQ ID NOs: 658 and 666, respectively; or the alpha and beta chains comprise the amino acid sequences of SEQ ID NOs: 673 and 684, respectively.

322. The TCR or antigen-binding fragment thereof of any of embodiments 292-321, wherein the alpha and/or beta chain further comprises a signal peptide.

323. The TCR or antigen-binding fragment thereof of embodiment 322, wherein:
the alpha chain comprises the signal peptide comprising the amino acid sequence set forth in any of SEQ ID NOs: 181, 184, 187, 189, 190, 192, 193, 310, 311; and/or
the beta chain comprises the signal peptide comprising the amino acid sequence set forth in any of SEQ ID NOs: 182, 185, 186, 188, 191, or 194.

324. The TCR or antigen-binding fragment thereof of any of embodiments 292-323, that is isolated or purified or is recombinant.

325. The TCR or antigen-binding fragment thereof of any of embodiments 292-324, that is human.

326. The TCR or antigen-binding fragment thereof of any of embodiments 292-325, that is monoclonal.

327. The TCR or antigen-binding fragment thereof of any of embodiments 292-326, wherein the TCR or antigen-binding fragment thereof is single chain.

328. The TCR or antigen-binding fragment thereof of any of embodiments 292-327, wherein the TCR or antigen-binding fragment thereof comprises two chains.

329. The TCR or antigen-binding fragment thereof of any of embodiments 292-328, wherein the antigen-specificity is at least partially CD8-independent.

330. The TCR or antigen-binding fragment of any of embodiments 292-329 wherein the MHC molecule is an HLA-A2 molecule.

331. A nucleic acid molecule encoding the TCR or antigen-binding fragment thereof of any of embodiments 292-330, or an alpha or beta chain thereof.

332. The nucleic acid molecule of embodiment 331, comprising a nucleotide sequence encoding an alpha chain and/or a nucleotide sequence encoding a beta chain, wherein:
the nucleotide sequence encoding an alpha chain comprises the sequence set forth in any of SEQ ID NOS: 389, 430, 1019, 1021, 1023, 1025, 1027, 1029, 1031, 1033, 1035, 1037, 1039, 1041, 1043 or 1045, or a nucleotide sequence that has at least 90% sequence identity thereto;
the nucleotide sequence encoding a beta chain comprises the sequence set forth in SEQ ID NOS: 390, 431, 1020, 1022, 1024, 1026, 1028, 1030, 1032, 1034 1036, 1038, 1040, 1042, 1044 or 1046, or a nucleotide sequence that has at least 90% sequence identity thereto.

333. The nucleic acid molecule of embodiment 331, wherein the nucleotide sequence is codon-optimized.

334. The nucleic acid molecule of embodiment 331 or embodiment 332, comprising a nucleotide sequence encoding an alpha chain and/or a nucleotide sequence encoding a beta chain, wherein:
the nucleotide sequence encoding an alpha chain comprises the sequence to set forth in any of SEQ ID NOS: 1097, 1099, 1101, 1103, 1105, 1107, 1109, 1111, 1113, 1115, 1117, 1119, 1121, 1123, 1125 or 1127, or a nucleotide sequence that has at least 90% sequence identity thereto;
the nucleotide sequence encoding a beta chain comprises the sequence set forth in SEQ ID NOS: 1098, 1100, 1102, 1104, 1106, 1108, 1110, 1112, 1114, 1116, 1118, 1120, 1122, 1124, 1126 or 1128, or a nucleotide sequence that has at least 90% sequence identity thereto.

335. The nucleic acid molecule of any of embodiments 331-334, wherein the nucleotide sequence encoding the alpha chain and the nucleotide sequence encoding the beta chain are separated by a peptide sequence that causes ribosome skipping.

336. The nucleic acid molecule of embodiment 335, wherein the peptide that causes ribosome skipping is a P2A or T2A peptide and/or comprises the sequence of amino acids set forth in SEQ ID NO: 204 or 211.

337. The nucleic acid of any of embodiments 331-336, comprising the nucleotide sequence set forth in any of SEQ ID NOs: 432, 433, 434, 435, 436, 437, 438, 439, 440, 441, 442, 443, 444, 445, 446 or 447, or a nucleotide sequence having at least 90% sequence identity thereto.

338. The nucleic acid of any of embodiments 285-291 and 331-337, wherein the nucleic acid is synthetic.

339. The nucleic acid of any of embodiments 285-291 and 331-338, wherein the nucleic acid is cDNA.

340. A vector comprising the nucleic acid of any of embodiments 285-291 and 331-339.

341. The vector of embodiment 340, wherein the vector is an expression vector.

342. The vector of embodiment 340 or embodiment 341, wherein the vector is a viral vector.

343. The vector of embodiment 342, wherein the viral vector is a retroviral vector.

344. The vector of embodiment 342 or embodiment 343, wherein the viral vector is a lentiviral vector.

345. The vector of embodiment 344, wherein the lentiviral vector is derived from HIV-1.

346. An engineered cell comprising the nucleic acid molecule of any of embodiments 40-46 and 86-94 or vector of any of embodiments 340-345.

347. An engineered cell, comprising the TCR or antigen-binding fragment thereof of any of embodiments 246-384 and 292-330.

348. The engineered cell of embodiment 346 or embodiment 347, wherein the TCR or antigen-binding fragment thereof is heterologous to the cell.

349. The engineered cell of any of embodiments 346-348, wherein the engineered cell is a cell line.

350. The engineered cell of any of embodiments 346-349, wherein the engineered cell is a primary cell obtained from a subject.

351. The engineered cell of embodiment 350, wherein the subject is a mammalian subject.

352. The engineered cell of embodiment 350 or embodiment 351, wherein the subject is a human.

353. The engineered cell of any of embodiments 346-352, wherein the engineered cell is a T cell.

354. The engineered cell of embodiment 353, wherein the T cell is CD8+.

355. The engineered cell of embodiment 353, wherein the T cell is CD4+.

356. The engineered cell of any of embodiments 346-355, comprising a genetic disruption of a T cell receptor alpha constant (TRAC) gene and/or a T cell receptor beta constant (TRBC) gene.

357. The engineered cell of embodiment 356, wherein the TRBC gene is one or both of a T cell receptor beta constant 1 (TRBC1) or T cell receptor beta constant 2 (TRBC2) gene.

358. A method for producing a cell of any of embodiments 346-357, comprising introducing a vector of any of embodiments 93-98 into a cell in vitro or ex vivo.

359. The method of embodiment 358, wherein the vector is a viral vector and the introducing is carried out by transduction.

360. The method of embodiment 358 or embodiment 359, further comprising introducing into the cell one or more agent, wherein each of the one or more agent is independently capable of inducing a genetic disruption of a T cell receptor alpha constant (TRAC) gene and/or a T cell receptor beta constant (TRBC) gene.

361. The method of any of embodiment 360, wherein the one or more agent capable of inducing a genetic disruption comprises a DNA binding protein or DNA-binding nucleic acid that specifically binds to or hybridizes to the target site.

362. The method of embodiment 361, wherein the one or more agent capable of inducing a genetic disruption comprises (a) a fusion protein comprising a DNA-targeting protein and a nuclease or (b) an RNA-guided nuclease.

363. The method of embodiment 362, wherein the DNA-targeting protein or RNA-guided nuclease comprises a zinc finger protein (ZFP), a TAL protein, or a clustered regularly interspaced short palindromic nucleic acid (CRISPR)-associated nuclease (Cas) specific for a target site within the TRAC and/or TRBC gene.

364. The method of embodiment 363, wherein the one or more agent comprises a zinc finger nuclease (ZFN), a TAL-effector nuclease (TALEN), or and a CRISPR-Cas9 combination that specifically binds to, recognizes, or hybridizes to the target site.

365. The method of embodiment 363 or embodiment 364, wherein the each of the one or more agent comprises a guide RNA (gRNA) having a targeting domain that is complementary to the at least one target site.

366. The method of embodiment 365, wherein the one or more agent is introduced as a ribonucleoprotein (RNP) complex comprising the gRNA and a Cas9 protein.

367. The method of embodiment 366, wherein the RNP is introduced via electroporation, particle gun, calcium phosphate transfection, cell compression or squeezing.

368. The method of embodiment 366 or embodiment 367, wherein the RNP is introduced via electroporation.

369. The method of any of embodiments 365-368, wherein the one or more agent is introduced as one or more polynucleotide encoding the gRNA and/or a Cas9 protein.

370. A composition comprising engineered cells of any of embodiments 346-357.

371. The composition of embodiment 370, wherein the engineered cells comprise CD4+ and/or CD8+ T cells.

372. The composition of embodiment 370 or embodiment 371, wherein the engineered cells comprise CD4+ and CD8+ T cells.

373. A composition, comprising an engineered CD8+ cell of embodiment 354 and an engineered CD4+ cell of embodiment 355.

374. The composition of any of embodiments 370-373, wherein the TCR or antigen-binding fragment thereof binds to or recognizes a peptide epitope of HPV 16 in the context of an MHC molecule that is at least partially CD8-independent.

375. The composition of any of embodiments 371-374, wherein the CD8+ cell and CD4+ cell are engineered with the same TCR or antigen-binding fragment thereof and/or are each engineered with a TCR or antigen-binding fragment thereof that binds to or recognizes the same peptide epitope of HPV 16 in the context of an MHC molecule.

376. The composition of any of embodiments 370-375, further comprising a pharmaceutically acceptable excipient.

377. A method of treatment, comprising administering the engineered cell of any of embodiments 346-357 to a subject having a disease or disorder associated with HPV.

378. A method of treatment, comprising administering the composition of any of embodiments 370-376 to a subject having a disease or disorder associated with HPV.

379. The method of embodiment 377 or embodiment 378, wherein the disease or disorder is associated with HPV16.

380. The method of any of embodiments 377-379, wherein the disease or disorder is cancer.

381. The method of any of embodiments 377-380, wherein the subject is a human.

382. A composition of any of embodiments 370-376 for use in treating a disease or disorder associated with HPV.

383. Use of a composition of any of embodiments 370-376 for the manufacture of a medicament for treating a disease or disorder associated with HPV.

384. The composition of embodiment 382 or use of embodiment 383, wherein the disease or disorder is associated with HPV16.

385. The composition or use of any of embodiments 382-384, wherein the disease or disorder is cancer.

386. The composition or use of any of embodiments 382-385, wherein the subject is a human.

IX. Examples

The following examples are included for illustrative purposes only and are not intended to limit the scope of the invention.

Example 1: Screening and Selection of HPV-16 E6 and E7 Epitope-Specific T Cell Receptors from Normal Donors An exemplary autologous screening process using autologous dendritic and T cells, generally as described by Ho et al., *J. Immunol. Methods,* 310:1-2, 40-52, with indicated modifications, was performed to generate antigen-specific T cells that specifically bound to peptide epitopes of human papillomavirus 16 (HPV16) E6 and E7 proteins presented on MHC-I molecules. Clonal T cell lines were generated and their TCR sequences cloned by this method were cloned.

1A. Generation and Cloning of Human HPV-Specific T Cells and TCRs

Briefly, dendritic cells were derived from adherent fractions of peripheral blood mononuclear cell (PBMC) samples obtained from normal human HLA-A02:01 donors, by culturing over two days in the presence of GM-CSF and IL-4, followed by incubation beginning at day 3 in the presence of pro-inflammatory cytokines to produce mature dendritic cells. On Day 4, the resulting mature dendritic cells were harvested, washed and pulsed with HPV-16 E6- or E7-derived peptides, such as some of those shown in Table 13, including peptide epitopes E6 (29-38), E7 (11-19), and E7 (86-93).

TABLE 13

HPV-16 Epitopes

| Epitope Description | Epitope Name | SEQ ID NO. |
|---|---|---|
| KLPQLCTEL | E6(18-26) | 232 |
| TIHDIILECV | E6(29-38) | 233 |
| FAFRDLCIV | E6(52-60) | 234 |
| TLGIVCPI | E7(86-93) | 235 |
| YMLDLQPET | E7(11-19) | 236 |
| GTLGIVCPI | E7(85-93) | 237 |
| LLMGTLGIV | E7(82-90) | 238 |
| TLHEYMLDL | E7(7-15) | 239 |

On Day 5, autologous CD8+ T cells from normal human donors were incubated with the peptide-pulsed dendritic cells.

On Day 8, IFNγ in the cultures was measured as an indicator for cultures containing antigen-specific T cells. Cells from reactive co-cultures were selected and re-stimulated two or three times with peptide-pulsed dendritic cells to enrich for specific T cells. Following the repeated stimulations, populations of cells staining positive for peptide-loaded autologous MHC tetramers were identified by flow cytometry. Clonal lines were generated by cell sorting and/or limiting dilution cloning essentially as described by Ho et al. 2006.

Clones were cultured with peptide-pulsed T2 cells (cells deficient in transporter associated with antigen transport (TAP) but expressing MHC-I and thus able to present peptides loaded onto the cells), pulsed with the relevant peptide, e.g. E6 (29-38), E7 (11-19) or E7 (86-93). Level of IFNγ in the cultures, as compared to those resulting from co-culture with cells loaded with a non-HPV-derived (negative control) peptide, was measured as an indicator of T cell specificity for the peptide-MHC and functional activity. Flow cytometry-based staining was used to assess the ability of the clonal cell lines to bind, in a peptide-specific manner, to labeled peptide-MHC (HLA-A02:01) tetramers (either HLA-A2/E6 (29-38), HLA-A2/E7 (11-19) or HLA-A2/E7 (86-93)); tetramers containing an irrelevant peptide served as a negative control).

Table 14 lists sequence identifiers corresponding to TCR alpha and beta chains expressed by clonal T cell lines generated via this process.

The ability of clonal lines to lyse target cells in an antigen-specific manner was assessed using peptide-pulsed T2 cells and/or cells of an antigen-expressing cancer cell line.

In an exemplary assay, monoclonal cell lines expressing the TCRs were incubated with the CaSki target cells (ATCC No. CRL-1550, containing approximately 600 copies of integrated HPV16) at various effector:target (E:T) ratios. Lytic activity was assessed by measuring caspase in the target cells and assessing the percentage of such cells that were positive to caspase at various time-points following initiation of incubation with the T cells, over 50 hours. Negative controls included incubation of T cells with SiHa cells (ATCC No. HTB-35, essentially negative for the endogenous target antigen, having no more than approximately one or two copies of integrated HPV16 genome) and Caski cells not incubated with T cell clones. The results for two exemplary clonal T cell lines are shown in FIG. 1. As shown, the monoclonal T cell lines were observed to exhibit lytic activity against cells presenting the subject HPV16-derived peptide in the context of HLA-A02:01. A number of CD8+ clones were generated and confirmed to exhibit antigen-specific binding and functionality by this process.

The ability of T cells of clonal lines to specifically bind to peptide epitopes independently of the CD8 co-receptor was assessed using a mutant MHC class I tetramer containing a D227K mutation in its CD8 binding site, rendering it unable to engage the CD8 co-receptor on T cells. See Kerry et al. *J Immunol* (2003) 171:4493-4503; Kerry et al. Immunology (2005) 114: 44-52. Table 14 lists exemplary TCRs expressed by exemplary clonal cell lines generated by this method. Each of these cell lines was observed in this study to bind the indicated peptide-MHC complex in an antigen-specific manner, as indicated by tetramer staining in comparison to control. Additionally, the indicated clonal lines were observed to specifically bind the relevant peptide in the context of the mutant (non-CD8 interacting) tetramers, indicating the ability of the TCRs expressed by these clonal lines to specifically bind to cognate antigen independently of CD8.

1B. Cloning of TCRs Expressed by Clonal Cell Lines

Polynucleotides having sequences encoding the polypeptide chains of TCRs from clonal lines generated as described above were amplified from T cell lines and sequenced using 5' rapid amplification of cDNA ends (RACE). Table 14 provides the sequence identifier (SEQ ID NO) for the alpha and beta chain nucleotide and amino acid sequences, respectively, for a plurality of TCRs generated by this process. Table 14 also lists the SEQ ID NO corresponding to an exemplary full-length encoded amino acid sequence containing the beta and alpha chain sequences of each respective TCR, separated by a ribosome-skip P2A sequence (P2A linker set forth in SEQ ID NO: 204, which may be encoded by a sequence of nucleotides set forth in any of SEQ ID NOs: 4, 5, 6, 207-210) (designated "beta-P2A-alpha"). A nucleotide sequence encoding such a full-length sequence for each of a number of TCRs was inserted into a vector for transfer into a host cell, such as a primary human cell, e.g., a T cell, as described below. Following translation of the nucleotide sequence and self-cleavage of the P2A sequence separating the TCR chains, the recombinant alpha and beta chain of the TCR were exogenously expressed in host cells, such as a primary T cell. The Table 14 also lists the specific Valpha and Vbeta usage for each cloned TCR.

TABLE 14

Amino Acid and Nucleotide Sequences of HPV-Specific TCRs

| | | Binding to Peptide in Complex with Mutant (non-CD8-binding) MHC tetramers by | | | SEQ ID NO. | | | | |
|---|---|---|---|---|---|---|---|---|---|
| | | | | | Full-length beta-P2A-alpha | alpha | | beta | |
| TCR | Epitope | Clonal Line | Valpha Usage | Vbeta Usage | aa | nt | aa | nt | aa |
| TCR 3 | E6(29-38) | Yes | TRAV14/DV4*02 | TRBV7-8*01 | 223 | 20 | 18 | 24 | 22 |
| TCR 4 | E6(29-38) | Yes | TRAV26-2*01 | TRBV7-9*03 | 224 | 30 | 28 | 34 | 32 |
| TCR 5 | E6(29-38) | No | TRAV14/DV4*02 | TRBV28*01 | 225 | 40 | 38 | 44 | 42 |
| TCR 7 | E7(11-19) | No | TRAV10*01 | TRBV2*01 | 227 | 60 | 58 | 64 | 62 |
| TCR 8 | E6(29-38) | No | TRAV21*02 | TRBV28*01 | 228 | 70 | 68 | 74 | 72 |
| TCR 9 | E6(29-38) | Yes | TRAV14/DV4*01 | TRBV6-2*01 | 229 | 80 | 78 | 84 | 82 |
| TCR 10 | E6(29-38) | Yes | TRAV12-1*01 | TRBV28*01 | 230 | 90 | 88 | 94 | 92 |
| TCR 11 | E7(86-93) | No | TRAV26-2*01 | TRBV29-1*01 | 231 | 100 | 98 | 104 | 102 |
| TCR 12 | E7(11-19) | Yes | | TRBV2*01 | 340 | 183 | 283 | 108 | 52, 285 |
| TCR 13 | E6(29-38) | Yes | TRAV8-2 | TRBV10-3 | 341 | 202 | 287 | 17 | 289 |
| TCR 14 | E6(29-38) | | TRAV24 | TRBV28 | 342 | 219 | 291 | 16 | 293 |

1C. Codon Optimization, Modification and Lentiviral Expression

Nucleotide sequences encoding TCRs generated as described above were modified by codon optimization and/or by mutation(s) to promote the formation of a non-native disulfide bond in the interface between the TCR constant domains to increase pairing and stability of the TCR. The non-native disulfide bond was promoted by modifying the TCR chains at residue 48 in the Cα region from Thr to Cys and residue 57 of the Cβ region from Ser to Cys (see Kuball et al. (2007) Blood, 109:2331-2338). The corresponding SEQ ID NO for the resulting modified nucleotide sequences and corresponding encoded amino acid sequences for the modified version of each TCR are shown in Table 15.

For individual TCRs modified as described above, constructs were generated that contained the modified nucleotide sequences encoding the beta chain and alpha chain, respectively, of the cloned TCRs, separated by a sequence encoding a P2A polypeptide were generated and inserted into a lentiviral vector, which were used to transduce T cell lines and primary T cells using standard methods, to express the encoded TCR chains.

TABLE 15

Codon Optimized, Cysteine Modified Version of the TCRs

| | | SEQ ID NO. of Modified Version of TCR | | | | |
|---|---|---|---|---|---|---|
| | | Full-length | alpha | | beta | |
| TCR | Epitope | nt | nt | aa | nt | aa |
| TCR 3 | E6(29-38) | 26 | 21 | 19 | 25 | 23 |
| TCR 4 | E6(29-38) | 36 | 31 | 29 | 35 | 33 |
| TCR 5 | E6(29-38) | 46 | 41 | 39 | 45 | 43 |
| TCR 6 | E7(11-19) | 56 | 51 | 49 | 54 | 53, 286 |
| TCR 7 | E7(11-19) | 66 | 61 | 59 | 65 | 63 |
| TCR 8 | E6(29-38) | 76 | 71 | 69 | 75 | 73 |
| TCR 9 | E6(29-38) | 86 | 81 | 79 | 85 | 83 |
| TCR 10 | E6(29-38) | 96 | 91 | 89 | 95 | 93 |
| TCR 11 | E7(86-93) | 106 | 101 | 99 | 105 | 103 |
| TCR 12 | E7(11-19) | 15 | 12 | 284 | 9 | 53, 286 |
| TCR 13 | E6(29-38) | 14 | 11 | 288 | 8 | 290 |
| TCR 14 | E6(29-38) | 13 | 10 | 292 | 7 | 294 |

Example 2: Expression and Antigen-Binding of Exemplary TCRs in Jurkat Cells

Exemplary E6-specific and E7-specific T cell receptors (TCRs), generated as described above, were assessed for surface expression on T cells and antigen-specific binding with or without CD8 interaction. Specifically, cells derived from the Jurkat human T cell line that did not express the endogenous TCR on their surfaces (CD4+ Jurkat-derived cells), with or without exogenously expressed CD8, referred to in FIG. 2A, FIG. 2B, FIG. 3 and FIG. 4, as CD8+ and CD4+, respectively, were engineered to express the modified version of the TCRs. For each TCR assessed in this process, the Jurkat-derived cells were transduced with a lentiviral vector particle generated as described above encoding the particular modified version of the TCR. Cells (those containing or not containing exogenous CD8) not transduced with a TCR were used as controls. At day 6 post-transduction with the sequence encoding each TCR, TCR expression and functional activity were assessed by flow cytometry, following staining with labeled tetramers complexed with the respective E6- or E7-peptide (either HLA-A2/E6 (29-38), HLA-A2/E7 (11-19) or HLA-A2/E7 (86-93) tetramer). A reference TCR capable of binding to HLA-A2/E6 (29-38) also was assessed in this study.

Figure 2A:
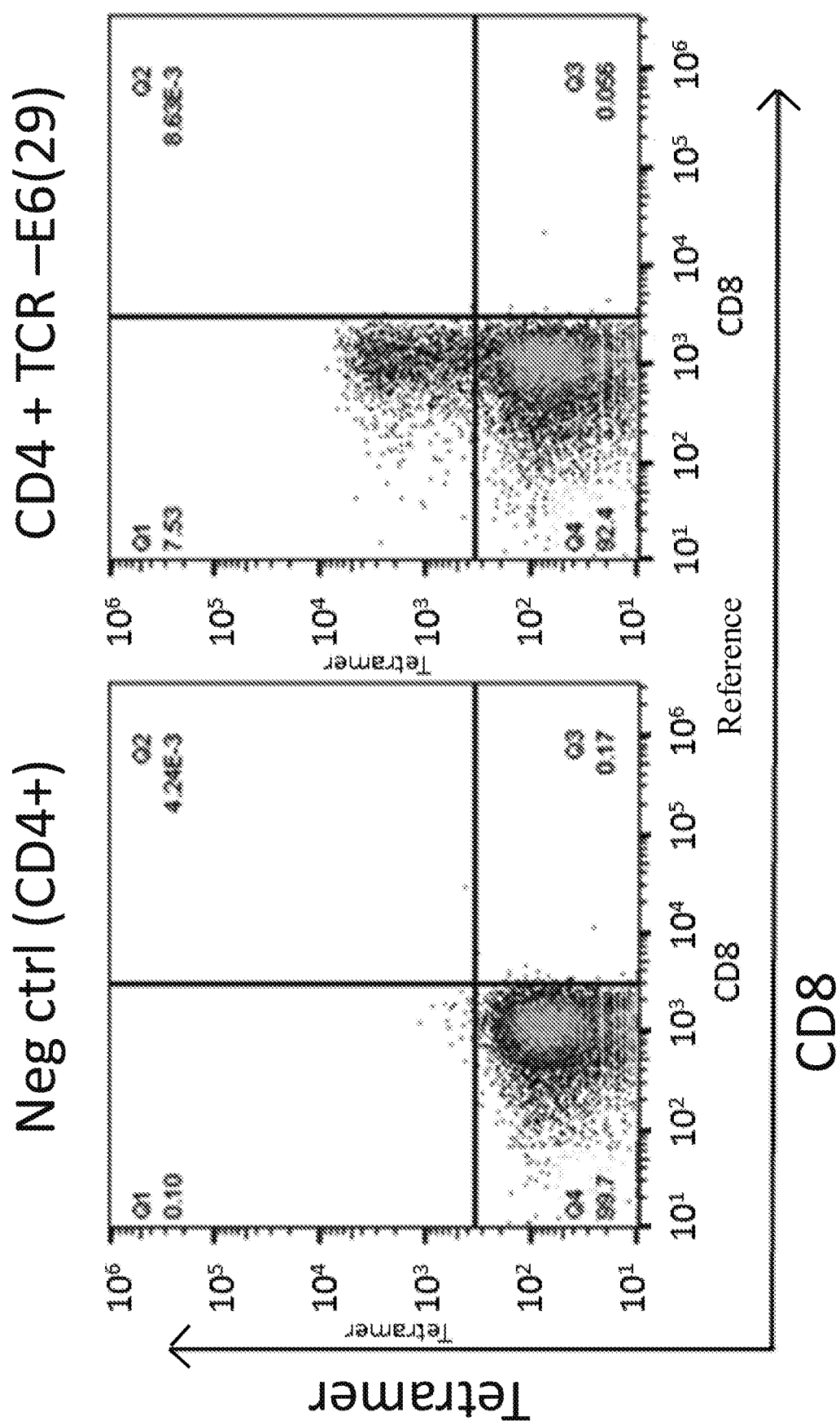
FIG. 2A and FIG. 2B show flow cytometry results for tetramer binding by a CD4+ Jurkat-derived cell line (Neg ctrl CD4+), the CD4+ Jurkat-derived cell line expressing various E6(29-38)-specific TCRs (CD4+ TCR-E6(29)), the CD4+ Jurkat-derived cell line that also expresses exogenous CD8 (CD8), or the CD4+ Jurkat-derived cell line that also expresses exogenous CD8 and various E6(29-38)-specific TCRs (CD8+ TCR-E6(29)). Specifically, results are shown for a reference TCR, the modified version of TCR 5, the modified version of TCR 4, the modified version of TCR 3 and the modified version of TCR 8.
Figure 2A:
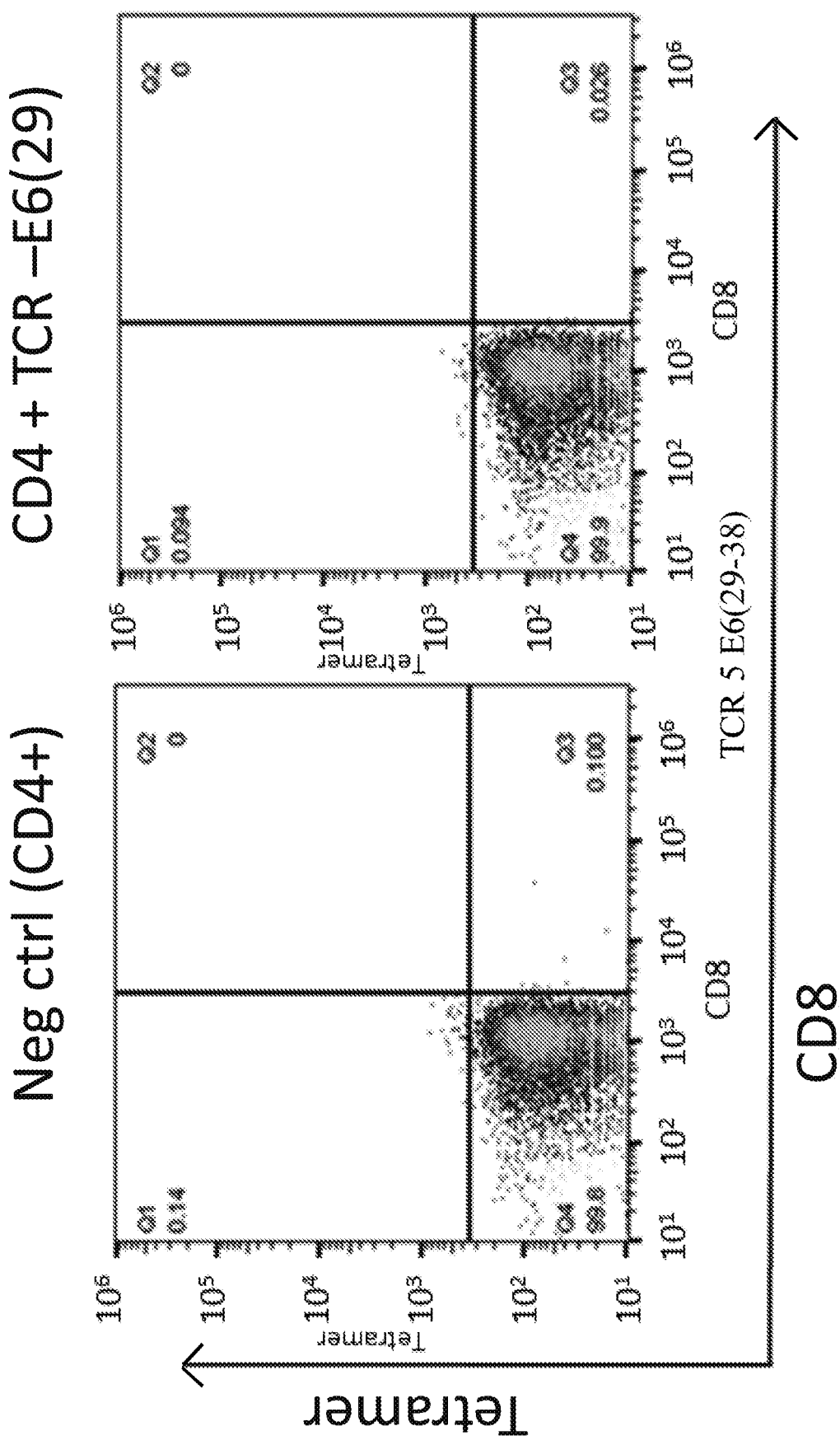
Figure 2A:
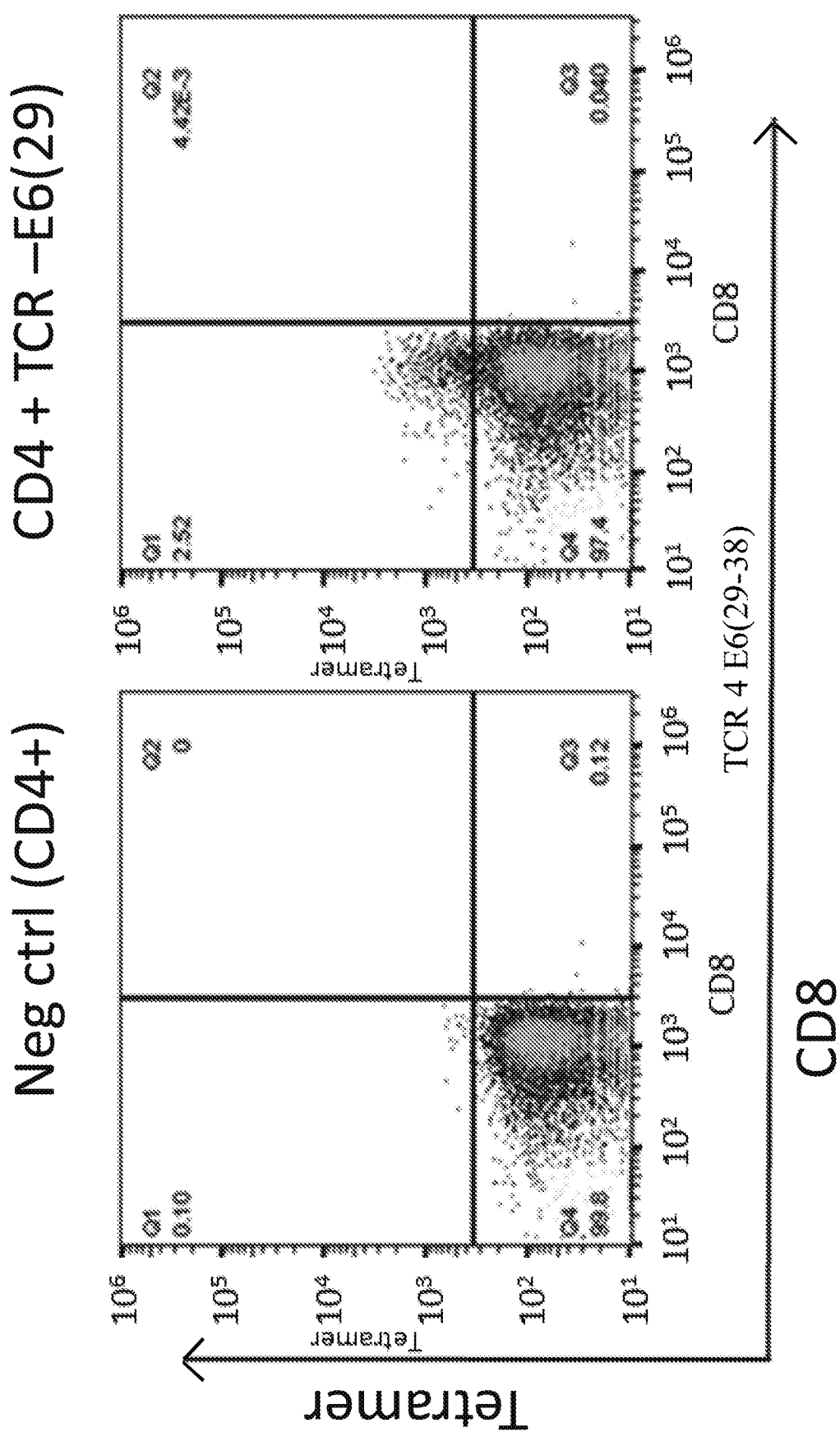
Figure 2A:
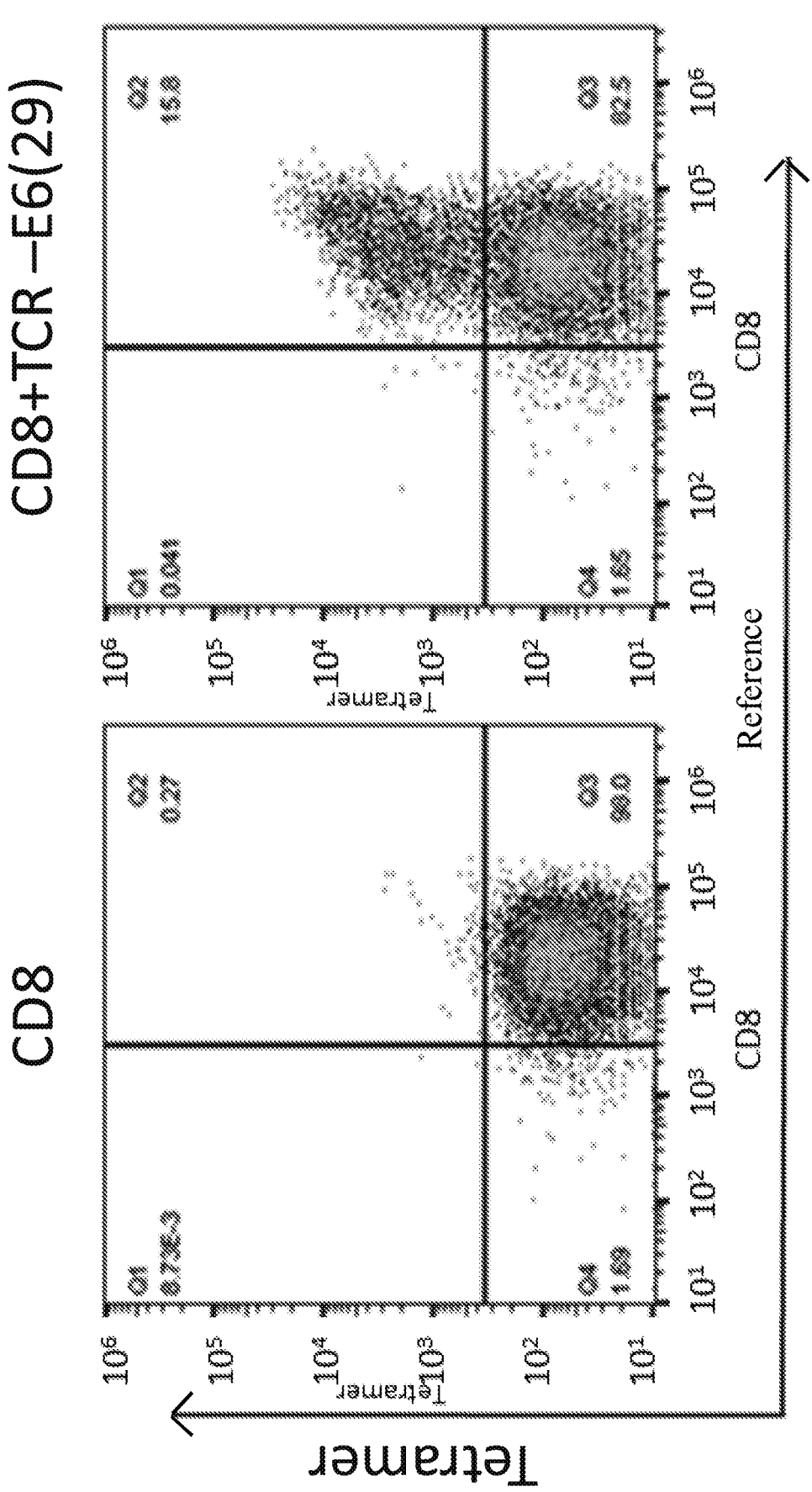
Figure 2A:
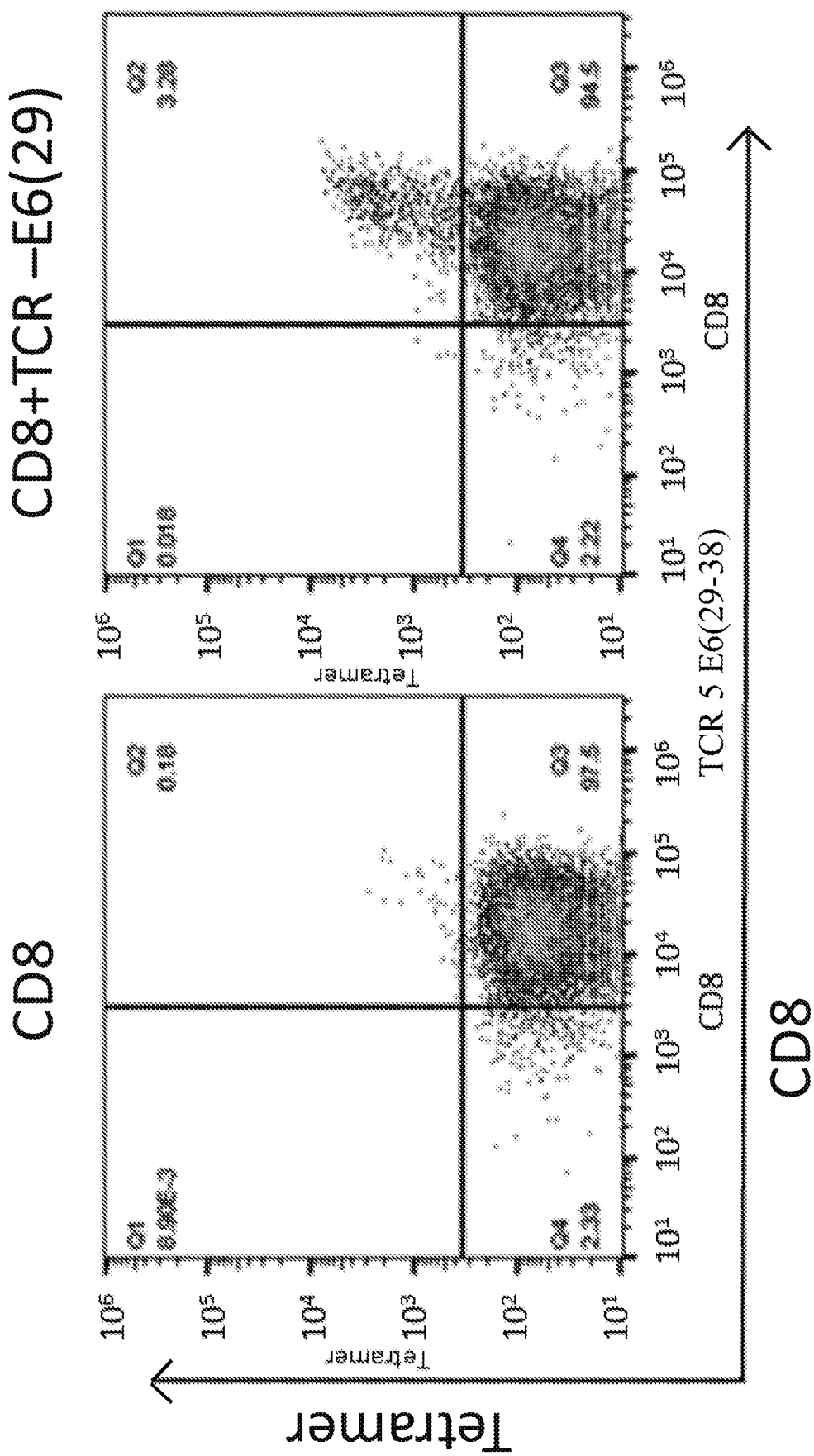
Figure 2A:
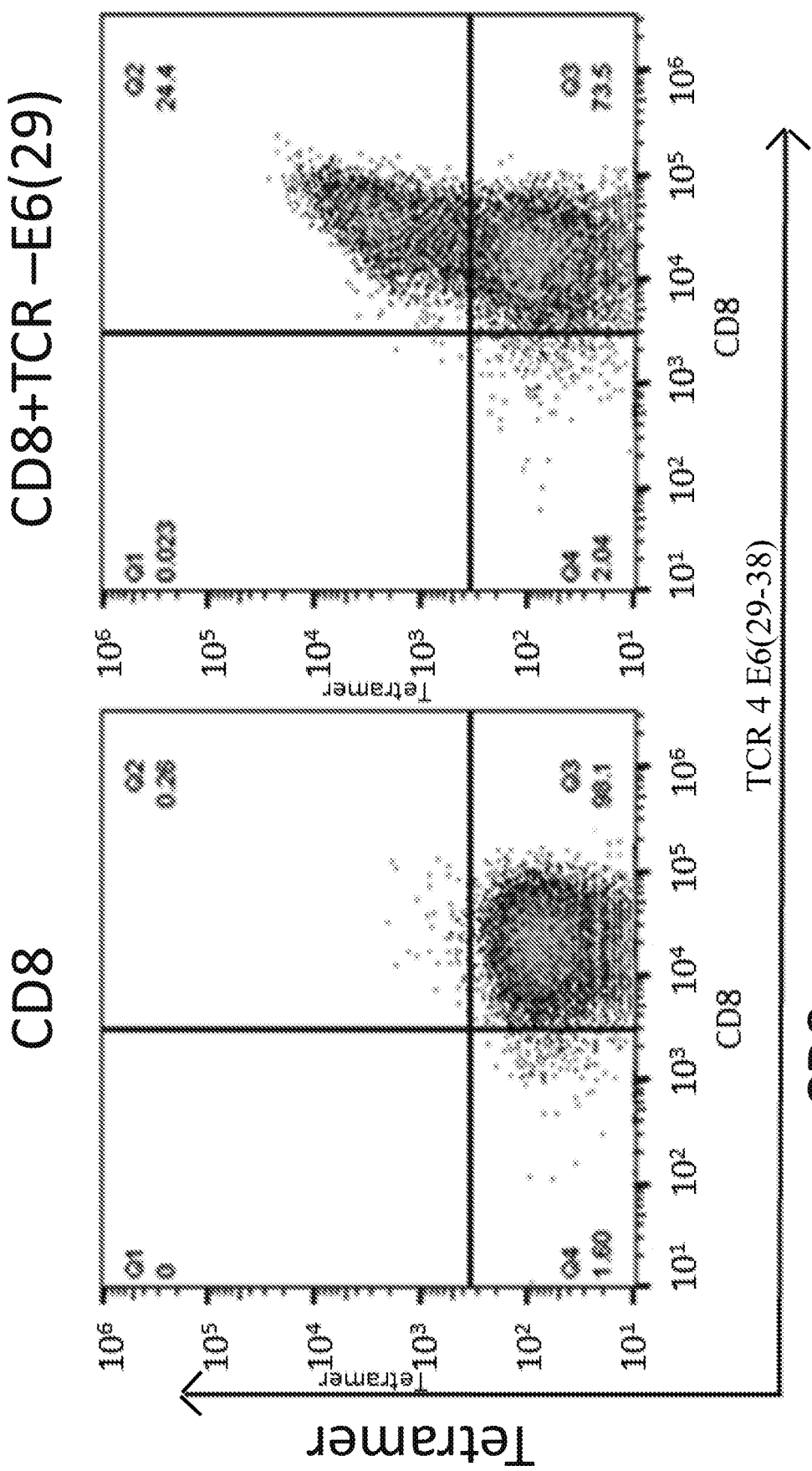
Figure 2B:
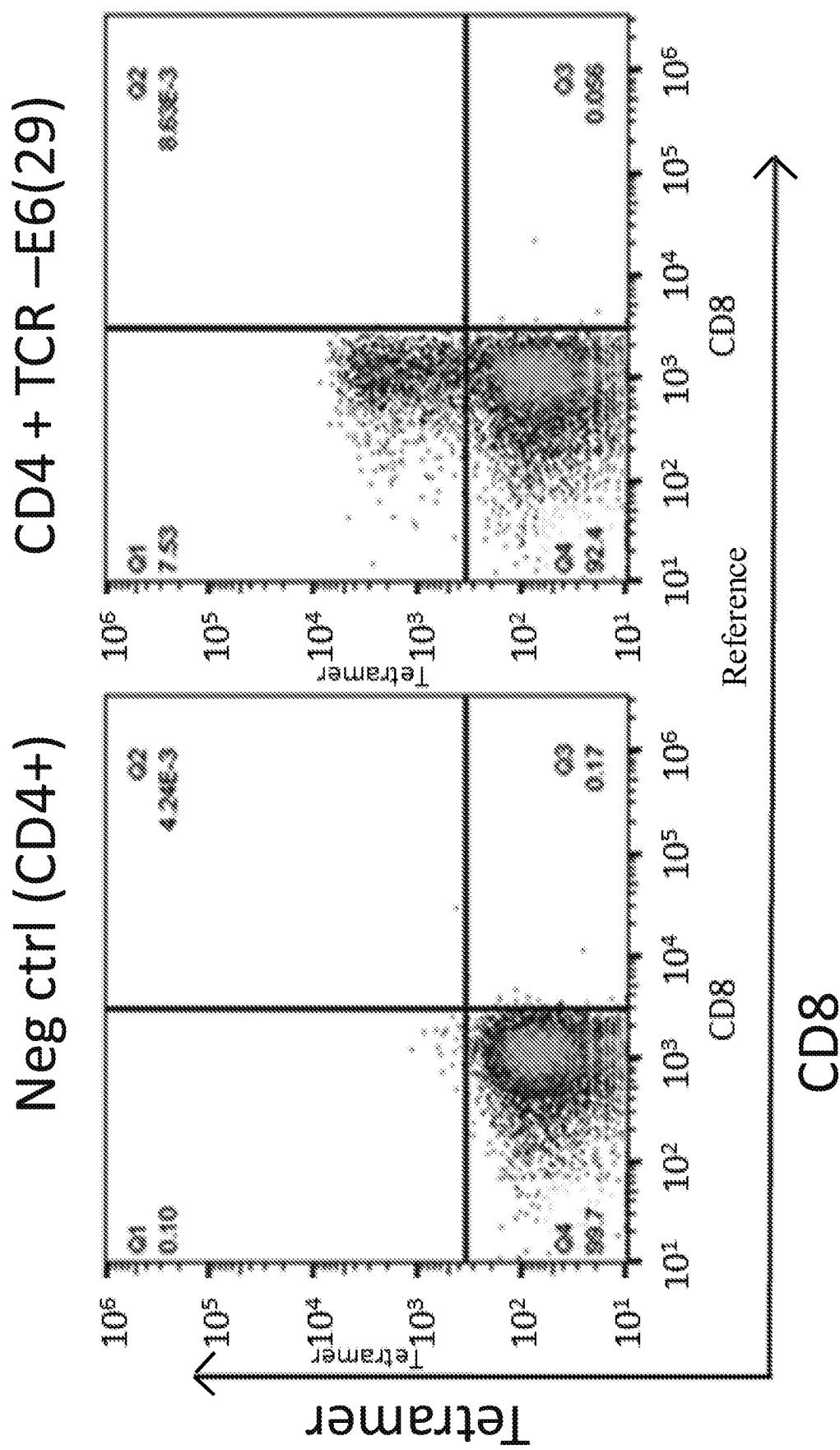
Figure 2B:
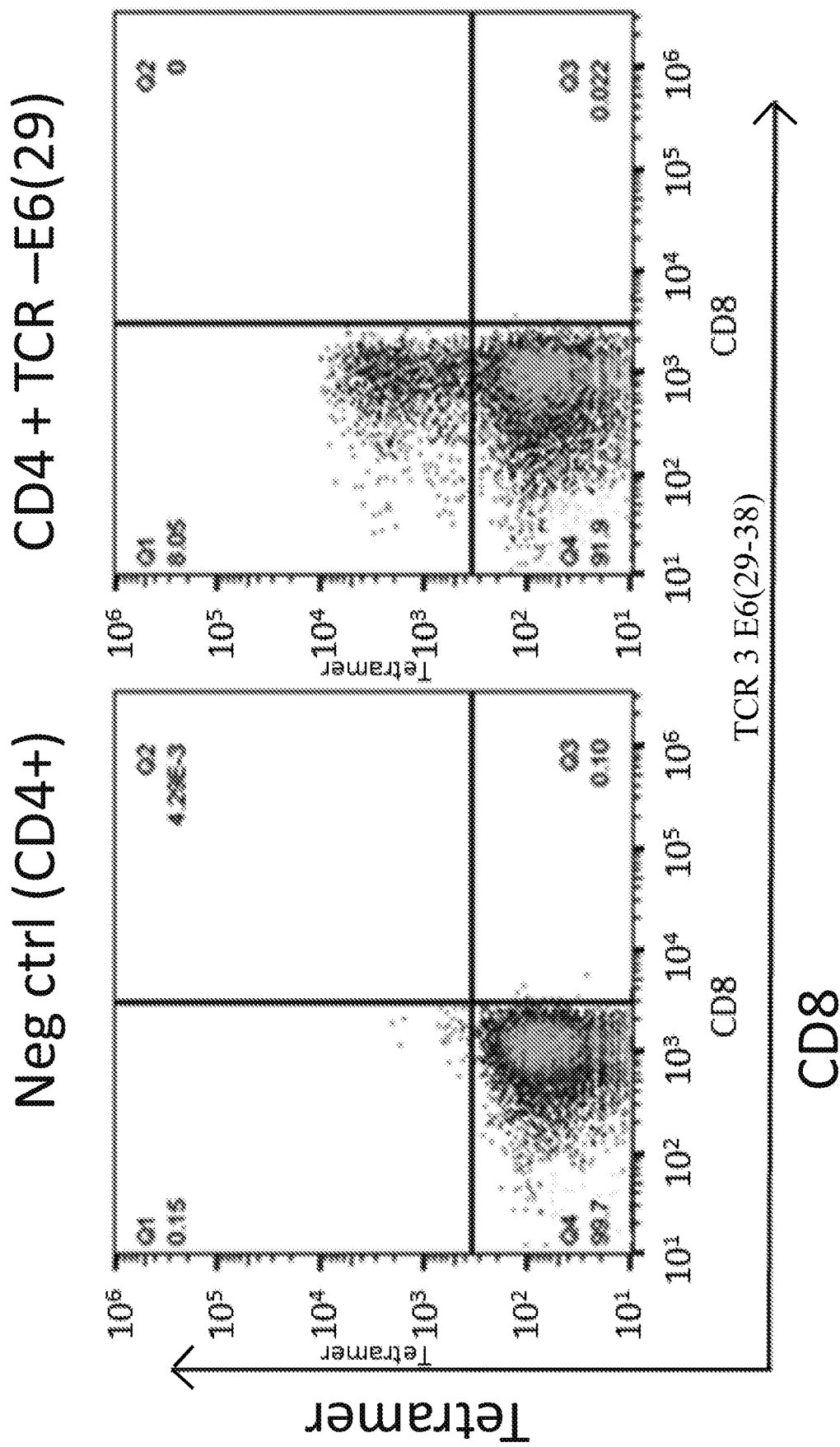
Figure 2B:
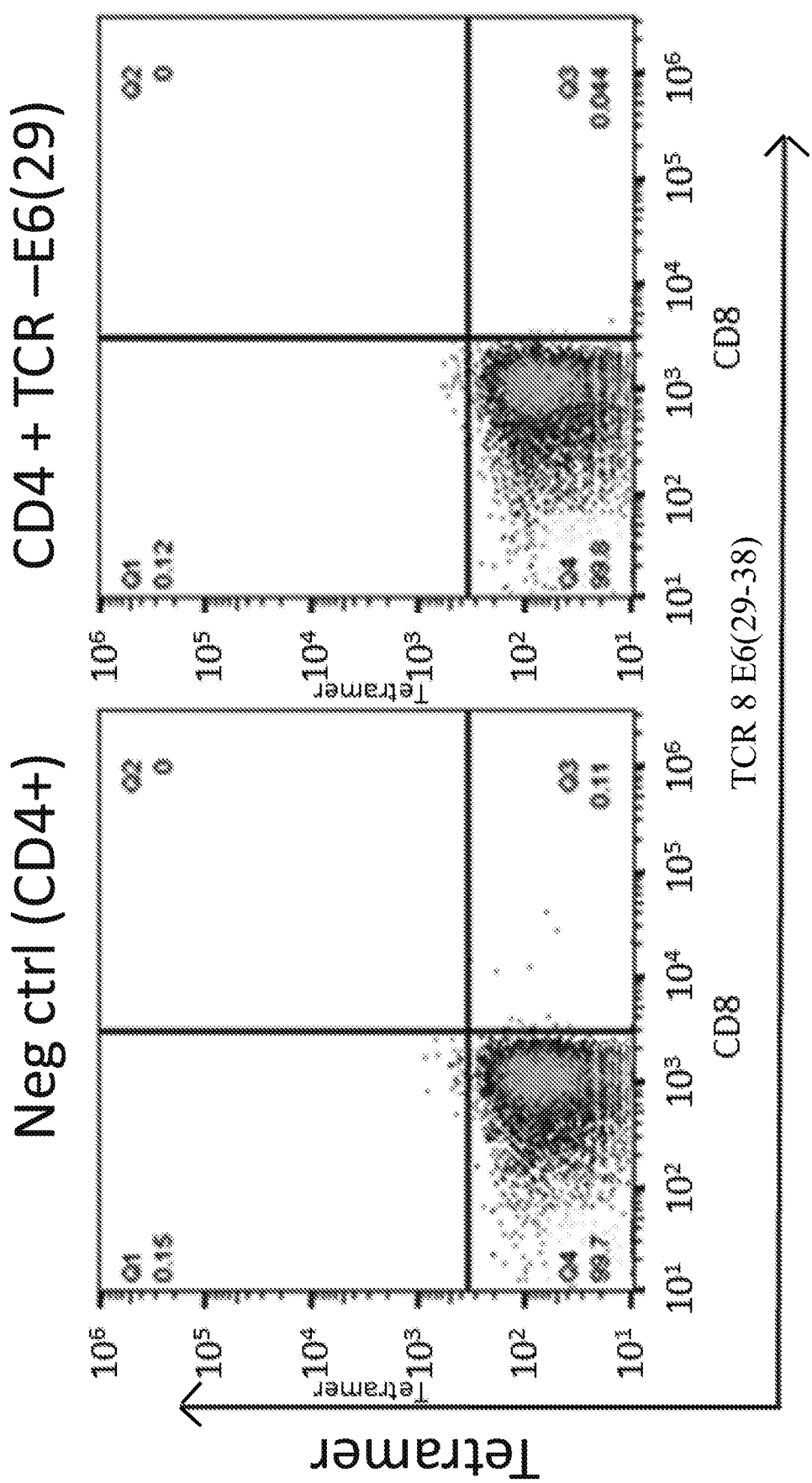
Figure 2B:
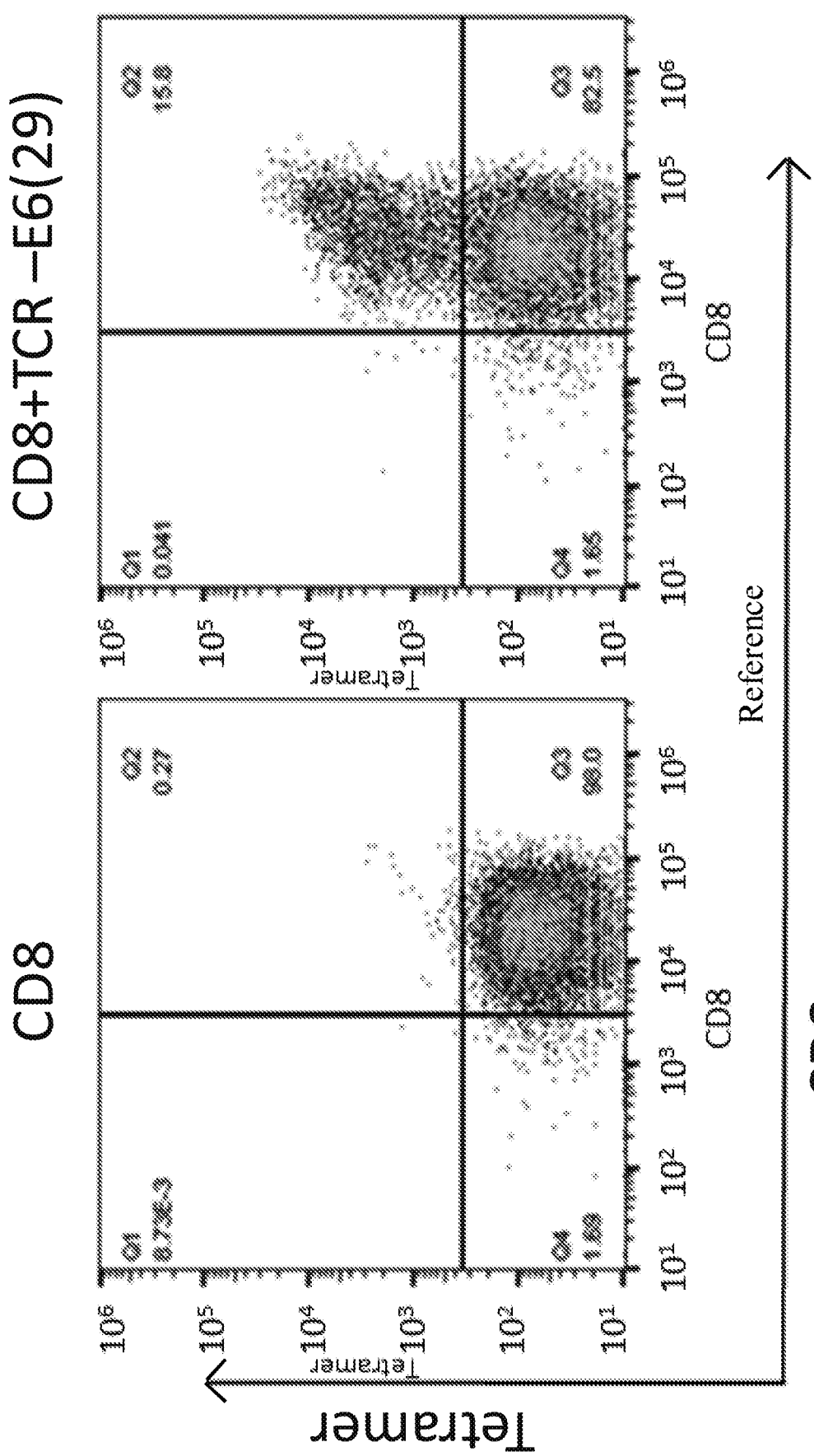
Figure 2B:
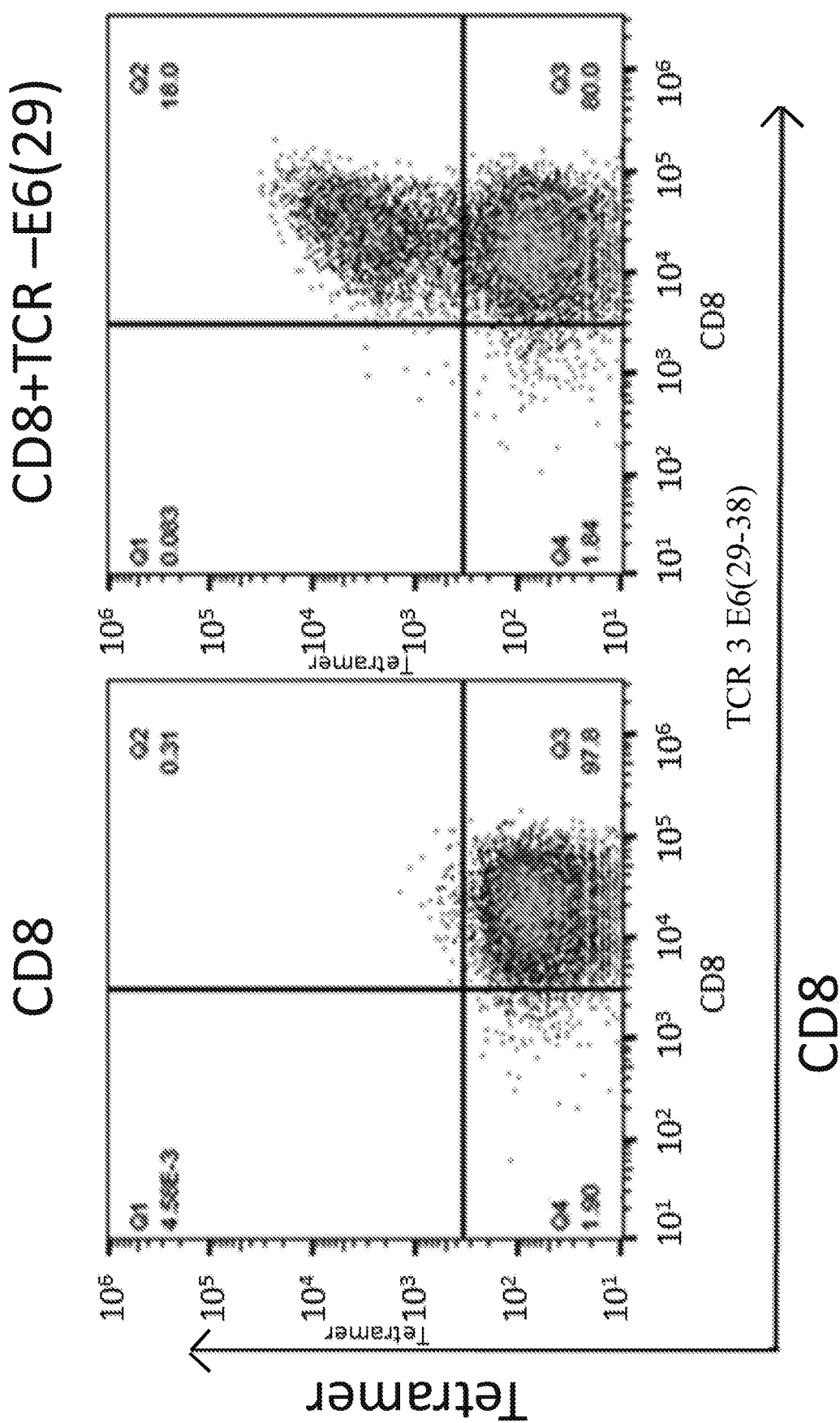
Figure 2B:
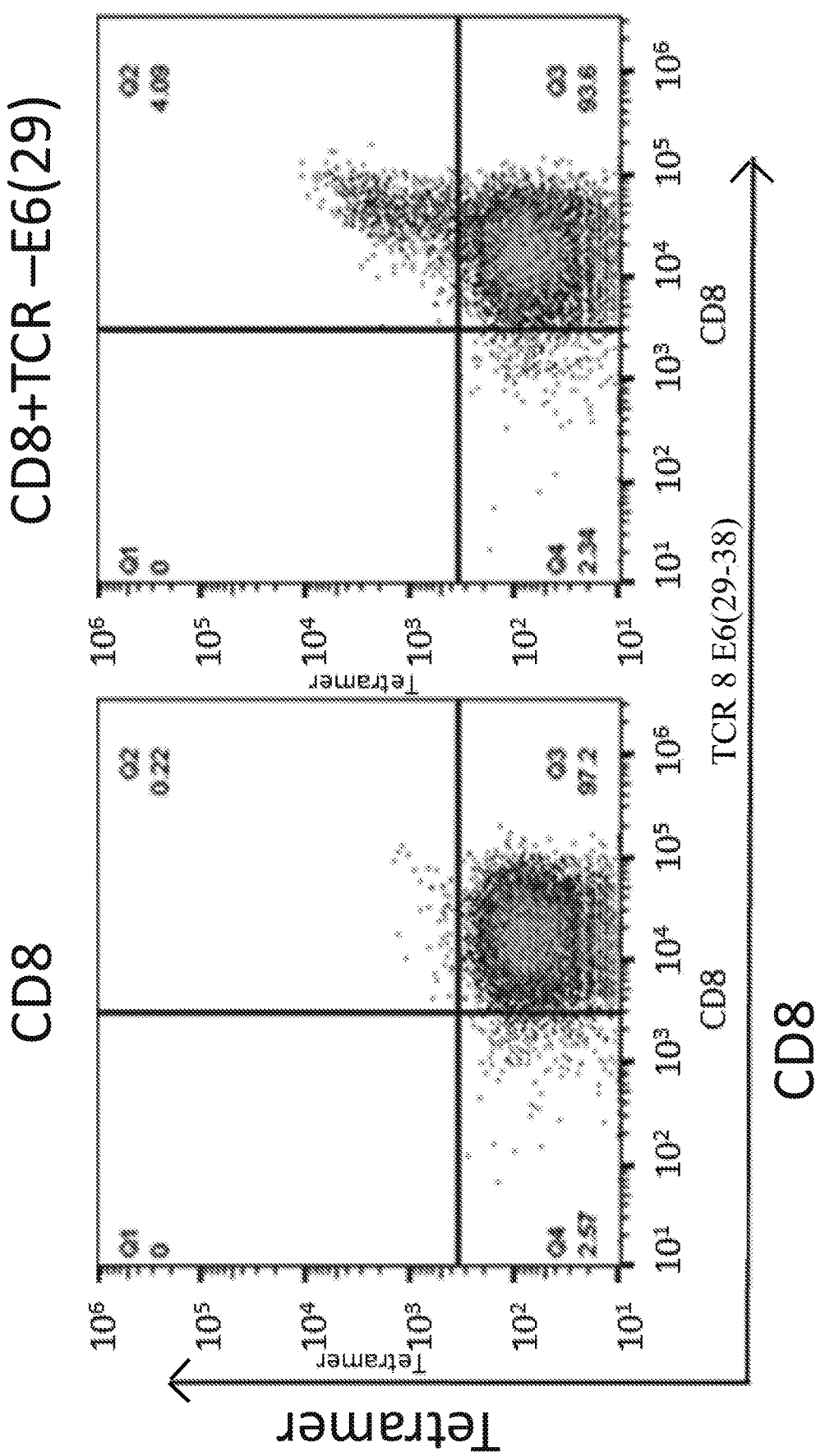
Figure 3:
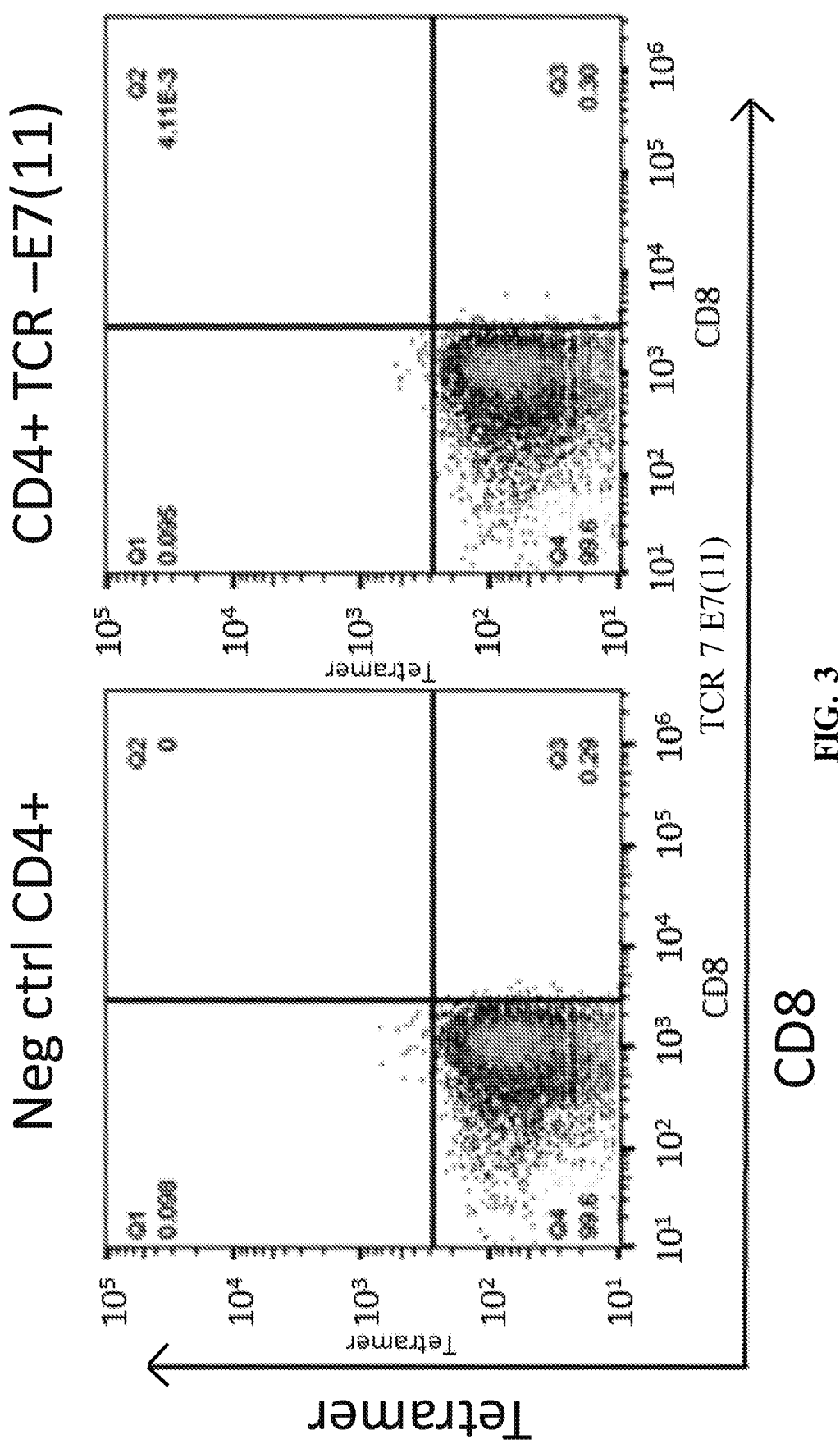
FIG. 3 shows flow cytometry results for tetramer binding by CD4+ Jurkat-derived cell line (Neg ctrl CD4+), the CD4+ Jurkat-derived cell line expressing various E7(11-19)-specific TCRs (CD4+ TCR-E7(11-19)), the CD4+ Jurkat-derived cell line that also expresses exogenous CD8 (CD8), or the CD4+ Jurkat-derived cell line that also expresses exogenous CD8 and various E7(11-19)-specific TCRs (CD8+ TCR-E7(11-19)). Specifically, results are shown for the modified version of TCR 7 and the modified version of TCR 12.
Figure 3:
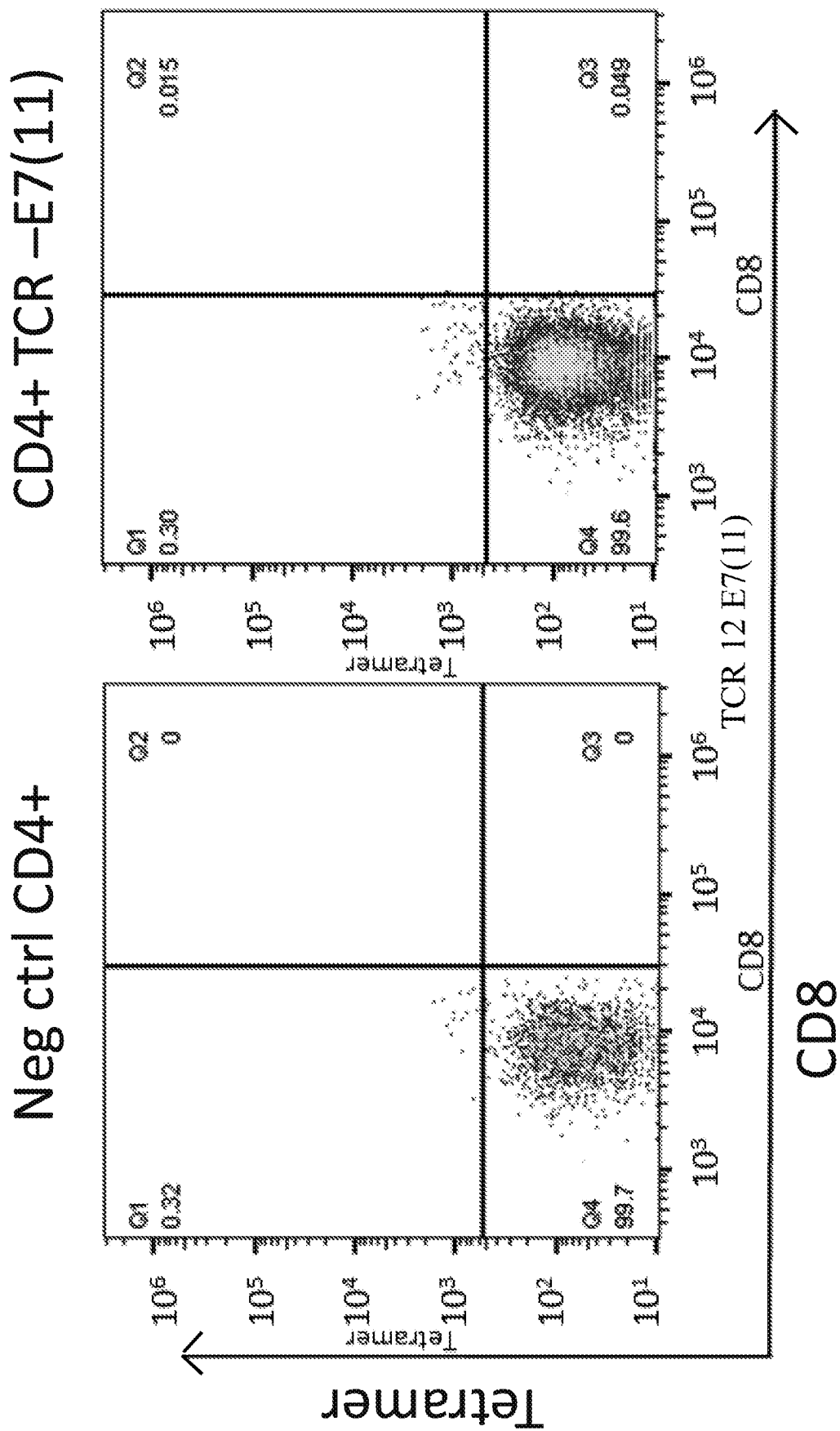
Figure 3:
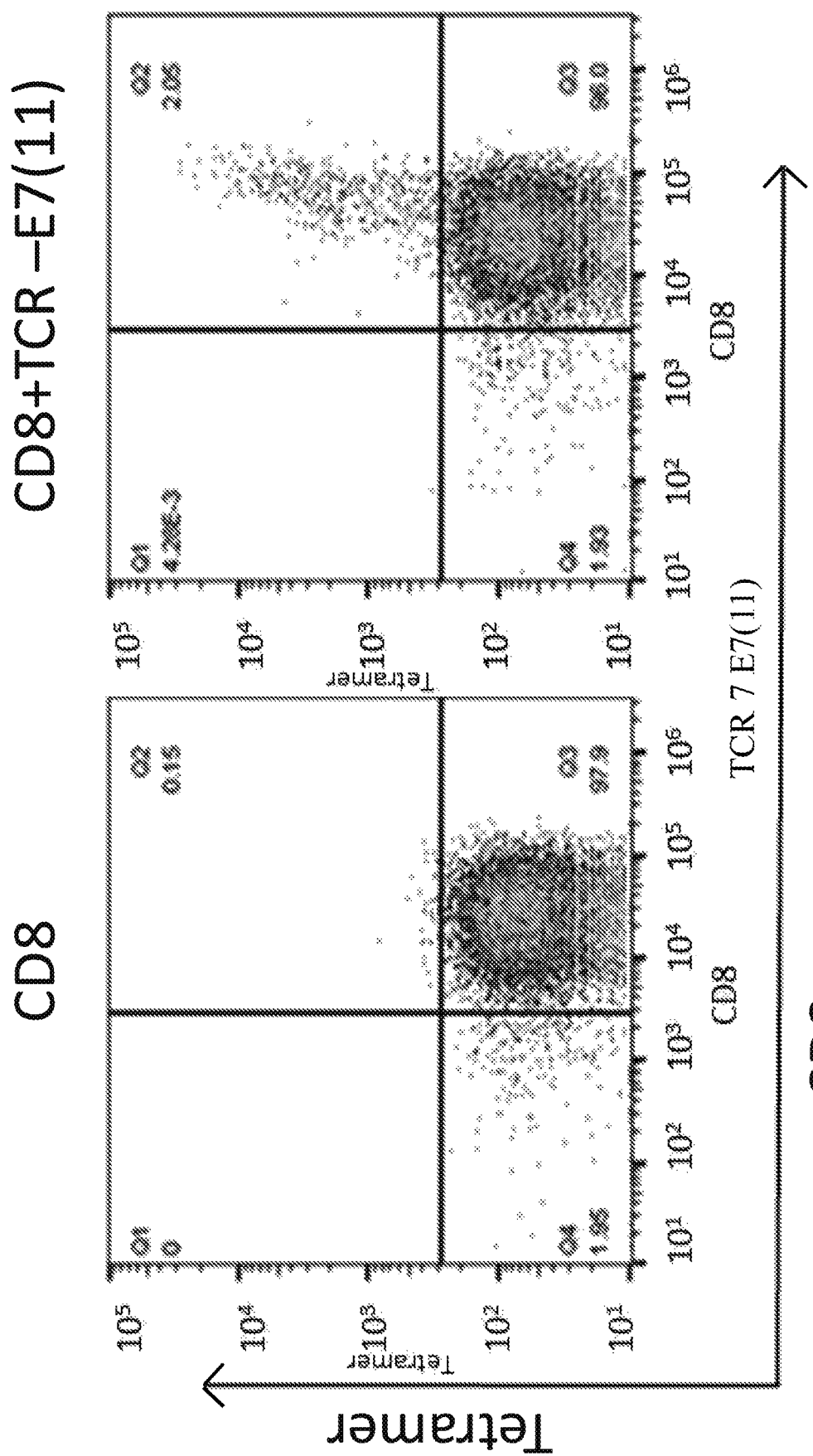
Figure 3:
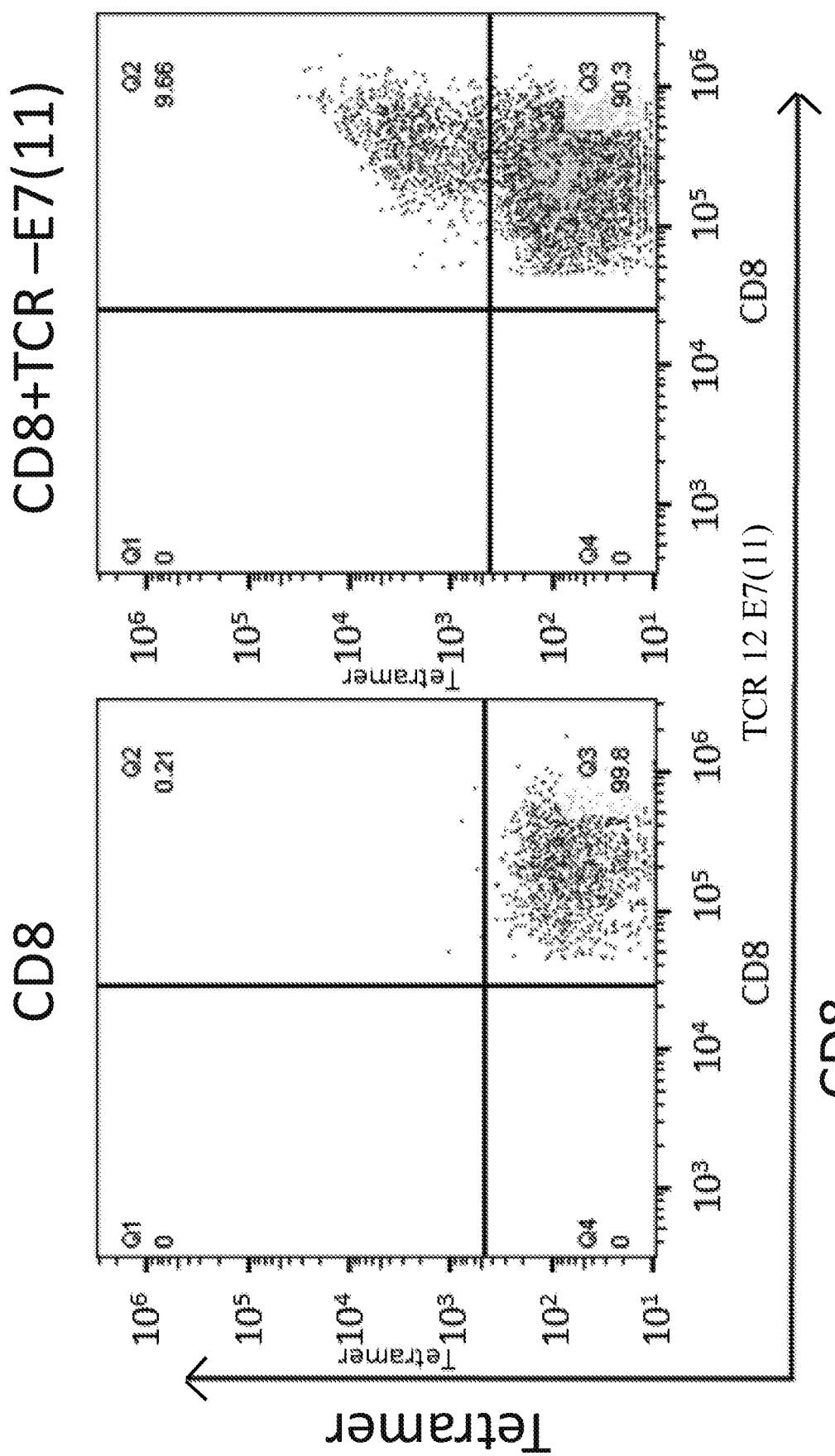
Figure 4:
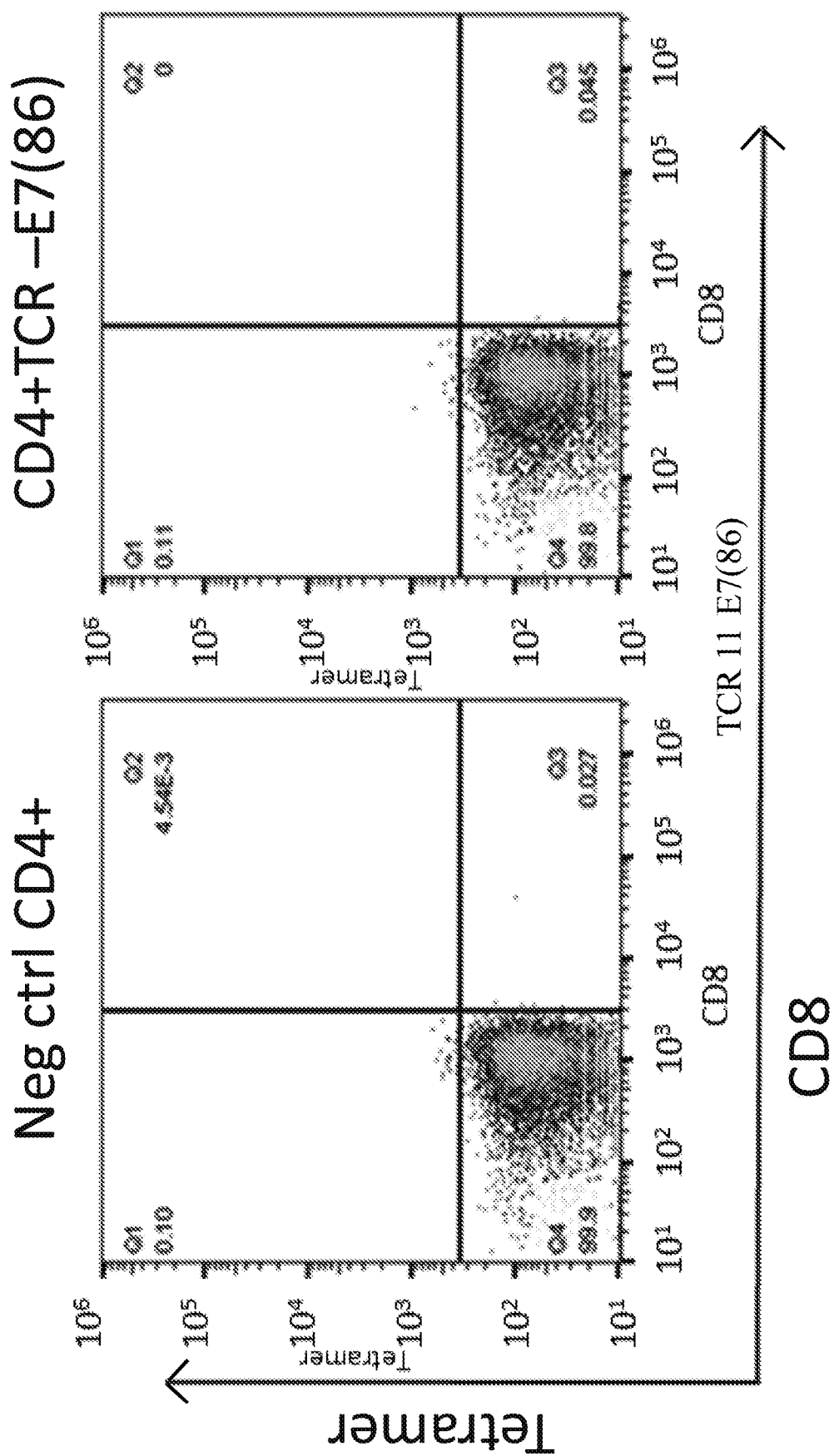
FIG. 4 shows flow cytometry results for tetramer binding by CD4+ Jurkat-derived cell line (Neg ctrl CD4+), the CD4+ Jurkat-derived cell line expressing various E7(86-93)-specific TCRs (CD4+ TCR-E7(86-93)), the CD4+ Jurkat-derived cell line that also expresses exogenous CD8 (CD8), or the CD4+ Jurkat-derived cell line that also expresses exogenous CD8 and various E7(86-93)-specific TCRs (CD8+ TCR-E7(86-93)). Specifically, results are shown for the modified version of TCR 11.
Figure 4:
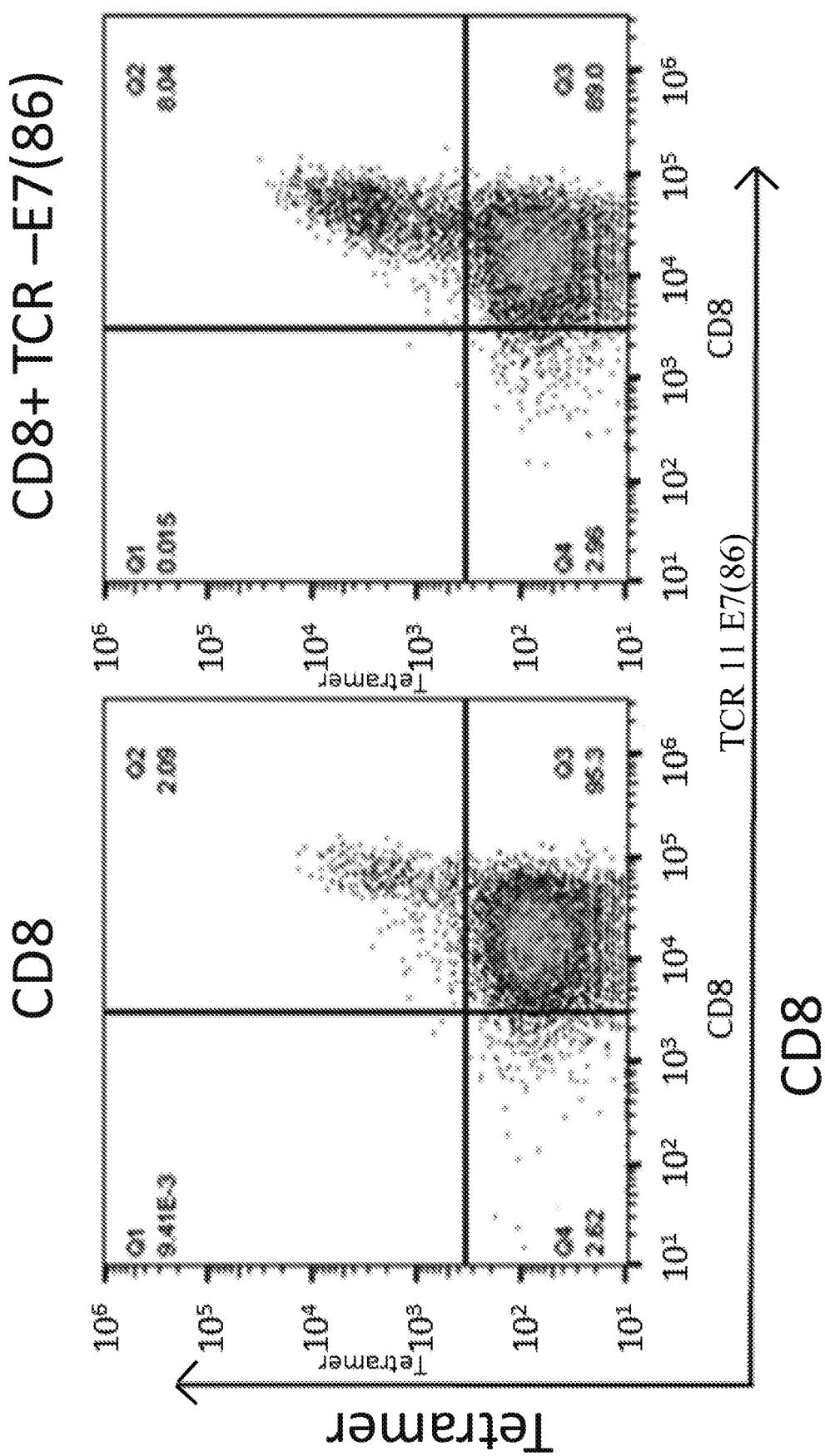

Exemplary results are shown in FIG. 2A and FIG. 2B (E6(29-38)-loaded tetramer binding), FIG. 3 (E7 (11-19)-loaded tetramer binding) and FIG. 4 (E7(86-93)-loaded tetramer binding). The percentage of cells in the indicated quadrants in flow cytometry plots shown in FIGS. 2A, 2B, 3 and 4 are also summarized below in Table 16 (FIG. 2A), Table 17 (FIG. 2B), Table 18 (FIG. 3) and Table 19 (FIG. 4).

TABLE 16

Percentage of cells present in each indicated quadrant in Flow Cytometry Plots Shown in FIG. 2A

| TCR/Cells | E6 tet+/CD8− quadrant | E6 tet+/CD8+ quadrant | E6 tet−/CD8+ quadrant | E6 tet−/CD8− quadrant |
|---|---|---|---|---|
| Reference/Neg Ctrl (CD4+) | 0.1 | 4.24E−03 | 0.17 | 99.7 |
| Reference/CD4+ TCR − E6(29) | 7.53 | 8.63E−03 | 0.056 | 92.4 |
| TCR 5/Neg Ctrl (CD4+) | 0.14 | 0 | 0.1 | 99.8 |
| TCR 5/CD4+ TCR − E6(29) | 0.094 | 0 | 0.026 | 99.9 |
| TCR 4/Neg Ctrl (CD4+) | 0.1 | 0 | 0.12 | 99.8 |
| TCR 4/CD4+ TCR − E6(29) | 2.52 | 4.42E−03 | 0.04 | 97.4 |
| Reference/CD8 | 8.73E−03 | 0.27 | 98 | 1.69 |
| Reference/CD8+ TCR − E6(29) | 0.041 | 15.8 | 82.5 | 1.65 |
| TCR 5/CD8 | 8.90E−03 | 0.18 | 97.5 | 2.33 |
| TCR 5/CD8+ TCR − E6(29) | 0.018 | 3.28 | 94.5 | 2.22 |
| TCR 4/CD8 | 0 | 0.26 | 98.1 | 1.6 |
| TCR 4/CD8+ TCR − E6(29) | 0.023 | 24.4 | 73.5 | 2.04 |

TABLE 17

Percentage of cells present in each indicated quadrant in Flow Cytometry Plots Shown in FIG. 2B

| TCR/Cells | E6 tet+/CD8− quadrant | E6 tet+/CD8+ quadrant | E6 tet−/CD8+ quadrant | E6 tet−/CD8− quadrant |
|---|---|---|---|---|
| Reference/Neg Ctrl (CD4+) | 0.1 | 4.24E−03 | 0.17 | 99.7 |
| Reference/CD4+ TCR − E6(29) | 7.53 | 8.63E−03 | 0.056 | 92.4 |
| TCR 3/Neg Ctrl (CD4+) | 0.15 | 4.29E−03 | 0.1 | 99.7 |
| TCR 3/CD4+ TCR − E6(29) | 8.05 | 0 | 0.022 | 91.9 |
| TCR 8/Neg Ctrl (CD4+) | 0.15 | 0 | 0.11 | 99.7 |
| TCR 8/CD4+ TCR − E6(29) | 0.12 | 0 | 0.044 | 99.8 |

TABLE 17-continued

Percentage of cells present in each indicated quadrant in Flow Cytometry Plots Shown in FIG. 2B

| TCR/Cells | E6 tet+/CD8− quadrant | E6 tet+/CD8+ quadrant | E6 tet−/CD8+ quadrant | E6 tet−/CD8− quadrant |
|---|---|---|---|---|
| Reference/CD8 | 8.73E−03 | 0.27 | 98 | 1.69 |
| Reference/CD8+ TCR − E6(29) | 0.041 | 15.8 | 82.5 | 1.65 |
| TCR 3/CD8 | 4.58E−03 | 0.31 | 97.8 | 1.9 |
| TCR 3/CD8+ TCR − E6(29) | 0.083 | 18 | 80 | 1.84 |
| TCR 8/CD8 | 0 | 0.22 | 97.2 | 2.57 |
| TCR 8/CD8+ TCR − E6(29) | 0 | 4.09 | 93.6 | 2.34 |

TABLE 18

Percentage of cells present in each indicated quadrant in Flow Cytometry Plots Shown in FIG. 3

| TCR/Cells | E7 tet+/CD8− quadrant | E7 tet+/CD8+ quadrant | E7 tet−/CD8+ quadrant | E7 tet−/CD8− quadrant |
|---|---|---|---|---|
| TCR 7/Neg Ctrl (CD4+) | 0.098 | 0 | 0.29 | 99.6 |
| TCR 7/CD4+ TCR − E7(11) | 0.095 | 4.11E−03 | 0.3 | 99.6 |
| TCR 12/Neg Ctrl (CD4+) | 0.32 | 0 | 0 | 99.7 |
| TCR 12/CD4+ TCR − E7(11) | 0.3 | 0.015 | 0.049 | 99.6 |
| TCR 7/CD8 | 0 | 0.15 | 97.9 | 1.95 |
| TCR 7/CD8+ TCR − E7(11) | 4.28E−03 | 2.05 | 96 | 1.93 |
| TCR 12/CD8 | 0 | 0.21 | 99.8 | 0 |
| TCR 12/CD8+ TCR − E7(11) | 0 | 9.66 | 90.3 | 0 |

TABLE 19

Percentage of cells present in each indicated quadrant in Flow Cytometry Plots Shown in FIG. 4

| TCR/Cells | E7 tet+/CD8− quadrant | E7 tet+/CD8+ quadrant | E7 tet−/CD8+ quadrant | E7 tet−/CD8− quadrant |
|---|---|---|---|---|
| TCR 11/Neg Ctrl (CD4+) | 0.1 | 4.54E−03 | 0.027 | 99.9 |
| TCR 11/CD4+ TCR − E7(86) | 0.11 | 0 | 0.045 | 99.8 |
| TCR 11/CD8 | 9.41E−03 | 2.09 | 95.3 | 2.62 |
| TCR 11/CD8+ TCR − E7(86) | 0.015 | 8.04 | 89 | 2.96 |

As shown, TCRs generated by these methods were cloned and observed to be expressed on the surface of T cells and to bind HPV peptide in the context of MHC tetramers, in some cases independently of CD8 co-receptor.

Example 3: Functional Assessment of Cells Transduced with HPV-16 E6 and E7 Epitope-Specific T Cell Receptors Primary CD8+ T cells were transduced with a lentiviral vector particle generated as described above encoding chains of modified versions of TCRs specific for E6(29-38) in the context of HLA:A2:01, including exemplary modified versions of TCRs TCR 5, TCR 4, TCR 3, TCR 8, TCR 9, TCR 10 and TCR15. Such transduced T cells were assessed for functional activity, including the ability to generate cytokines and exhibit lytic activity in response to cells expressing the peptide:MHC. An exemplary E7(11-19)-specific TCR was used as a negative control in these studies.

A. Cytokine Production

To assess the production of cytokines in response to antigen, the cells were incubated for 4 hours at a 10:1 E:T ratio with T2 cells that had been pulsed overnight with 10 μM of E6(29-38) peptide or, as a control, 10 μM of E7(11-19) peptide. As a positive control, cytokine activity also was assessed in cultures of transduced T cells stimulated with either phorbol myristate acetate (PMA) and Brefeldin A (BFA) or with BFA alone. Intracellular IFNγ was measured in the cultured cells by flow cytometry. The percent of CD8 and intracellular IFNγ positive (% CD8+/IC IFNγ+) cells was determined by flow cytometry.

The results are shown in Table 20. These results confirmed the ability of primary human T cells expressing E6(29-38)-specific TCRs generated by these methods to produce cytokine in response to target cells in an antigen-specific manner.

TABLE 20

| Peptide/Treatment | TCR | Cytokine activity %CD8+/IC IFNγ+ |
|---|---|---|
| E6(29-38) | TCR 5 | 43.7 |
|  | TCR 7 | 70.5 |
|  | TCR 4 | 94.2 |
|  | TCR 3 | 95.1 |
|  | TCR 8 | 95.0 |
|  | TCR 9 | 91.1 |
|  | TCR 10 | 98.9 |
| E7(11-19) | TCR 5 | 7.22 |
|  | TCR 7 | 62.4 |
|  | TCR 4 | 2.5 |
|  | TCR 3 | 2.51 |
|  | TCR 8 | 11.4 |
|  | TCR 9 | 19.5 |
|  | TCR 10 | 1.17 |
| T cells + PMA + BFA | TCR 5 | 22.4 |
|  | TCR 7 | 89.4 |
|  | TCR 4 | 27.9 |
|  | TCR 3 | 94.4 |
|  | TCR 8 | 98.4 |
|  | TCR 9 | 22.3 |
|  | TCR 10 | 27.5 |
| T cells + BFA | TCR 5 | 4.83 |
|  | TCR 7 | 57.9 |
|  | TCR 4 | 1.87 |
|  | TCR 3 | 1.82 |
|  | TCR 8 | 8.18 |
|  | TCR 9 | 11.1 |
|  | TCR 10 | 0.63 |

B. Lytic Activity

Lytic activity of the transduced primary T cells against cells expressing HPV16 was assessed by incubating CaSki cells (in the presence or absence of IFNγ) at a 10:1 E:T ratio. Samples in which SiHa cells were used as the target cells at the same E:T ratio served as a negative control. Lytic activity also was assessed against T2 cells pulsed with peptide E6(29-38). The ability of the T cells to antigen-specifically cause lytic activity was assessed by measuring active-caspase in the target cells 4 hours post co-culture.

Example 4: Screening and Selection of HPV-16 E6 and E7 Epitope-Specific T Cell Receptors from Normal Donors A screening process using autologous dendritic and T cells was performed to generate antigen-specific T cell receptors (TCRs) that specifically bound to human papillomavirus 16 (HPV16) E6(29-38) or E7(11-19) peptide presented on MHC-I molecules and survived and/or were enriched over time, following multiple rounds of antigen-stimulation. Clonal T cell lines were generated and the sequences of individual paired TCR alpha and beta chains and abundance thereof in various populations were determined on a single-cell basis, using high-throughput paired TCR sequencing.

A. Generation and Cloning of Human HPV-Specific T Cells and TCRs

Briefly, peptide-pulsed antigen-presenting cells were generated from PBMCs substantially as described in Example 1. Specifically, peptide-pulsed HLA:A02:01APCs were generated with HPV 16 E6(29-38) peptide (TIHDIILECV; SEQ ID NO:233) or E7(11-19) peptide (YMLDLQPET; SEQ ID NO:236). Autologous CD8+ T cells from normal human donors were incubated over multiple rounds with the peptide-pulsed cells, and selections were carried out based on binding to peptide-loaded autologous MHC tetramers. Generally, cells were subjected to a total of three rounds of stimulation, in the presence of peptide-pulsed cells (with a peptide concentration of 1000 ng/mL maintained over the three rounds). Following the second and third rounds of stimulation, cells were sorted by flow cytometry into populations positive and negative, respectively, for binding to peptide-MHC tetramers containing the appropriate tetramer. Cells of the tetramer-positive and negative populations following each of the second and third rounds were subjected to single-cell TCR sequencing, to assess the presence and frequency of individual TCRs in the different populations, and the persistence of TCR clones over multiple rounds of antigen stimulation.

B. Determination of TCR Sequences and Assessment of TCRs

Cell populations from the positive and negative fractions (i.e., sorted by flow cytometry based on positive and negative staining, respectively, for binding to the E6(29-38) peptide-loaded, or E7(11-19) peptide-loaded, MHC tetramers, as determined by flow cytometry) following rounds 2 and 3 of stimulation were subject to high-throughput single-cell sequencing for TCR alpha and beta chain pairs. High throughput single cell TCR sequencing was performed as generally described in published PCT patent applications, publication numbers WO2012/048340, WO2012/048341 and WO2016/044227. The sequencing methods employed single-cell droplets and sample and molecular barcodes, to identify individual pairs of TCR alpha and beta chain sequences at a single-cell level, for each of a large number (e.g., millions) of single cells present in a single starting composition, and to assess abundance of each TCR pair in various populations assessed. The ability to identify and quantify TCR pairs at a single-cell level permitted the assessment of the frequency of each of various TCR pairs in each of the individual positive and negative fractions, and to assess enrichment and persistence of TCRs over multiple rounds of antigen stimulation. TCR pairs identified in this assay were selected based on their presence in the peptide-binding fractions following rounds 2 and 3, higher abundance in positive versus negative fractions in each of these rounds, and enrichment over time following multiple rounds of exposure to antigen.

Tables 21 and 22 list exemplary E6(29-38)- and E7(11-19)-specific TCRs isolated according to this method, respectively, and the sequence identifiers (SEQ ID NO:) for the alpha and beta chain nucleotide and amino acid sequences for each TCR. Tables 21 and 22 also list the sequence identifier (SEQ ID NO) corresponding to an exemplary full-length encoded amino acid sequence containing the beta and alpha chain sequences of each respective TCR, separated by a sequence encoding a ribosome-skip P2A sequence (P2A linker set forth in SEQ ID NO: 204) (designated "beta-P2A-alpha"). A nucleotide sequence encoding such a full-length sequence for each of a number of TCRs was inserted into a vector for transfer into a host cell, such as a primary human cell, e.g., a T cell, as described below. Following translation of the nucleotide sequence and self-cleavage of the P2A sequence separating the TCR chains, the recombinant alpha and beta chain of the TCR were exogenously expressed in host cells.

TABLE 21

Amino Acid and Nucleotide Sequences of HPV 16 E6(29-38)-Specific TCRs

| | | SEQ ID NO. | | | | |
|---|---|---|---|---|---|---|
| | | Full length beta-P2A-alpha sequence | alpha | | beta | |
| TCR | Epitope | aa | nt | aa | nt | aa |
| TCR 15 | E6(29-38) | 391 | 389 | 473 | 390 | 479 |
| TCR 16 | E6(29-38) | 392 | 430 | 488 | 431 | 494 |
| TCR 17 | E6(29-38) | 393 | 1019 | 500 | 1020 | 494 |
| TCR 18 | E6(29-38) | 394 | 1021 | 506 | 1022 | 512 |
| TCR 19 | E6(29-38) | 395 | 1023 | 518 | 1024 | 526 |
| TCR 20 | E6(29-38) | 396 | 1025 | 532 | 1026 | 541 |
| TCR 21 | E6(29-38) | 397 | 1027 | 550 | 1028 | 556 |
| TCR 22 | E6(29-38) | 398 | 1029 | 565 | 1030 | 574 |
| TCR 23 | E6(29-38) | 399 | 1031 | 583 | 1032 | 589 |
| TCR 24 | E6(29-38) | 400 | 1033 | 595 | 1034 | 601 |
| TCR 25 | E6(29-38) | 401 | 1035 | 607 | 1036 | 613 |
| TCR 26 | E6(29-38) | 402 | 1037 | 619 | 1038 | 625 |
| TCR 27 | E6(29-38) | 403 | 1039 | 633 | 1040 | 639 |
| TCR 28 | E6(29-38) | 404 | 1041 | 645 | 1042 | 651 |
| TCR 29 | E6(29-38) | 405 | 1043 | 657 | 1044 | 663 |
| TCR 30 | E6(29-38) | 406 | 1045 | 672 | 1046 | 681 |

TABLE 22

Amino Acid and Nucleotide Sequences of HPV 16 E7(11-19)-Specific TCRs

| | | SEQ ID NO. | | | | |
|---|---|---|---|---|---|---|
| | | Full length beta-P2A-alpha sequence | alpha | | beta | |
| TCR | Epitope | aa | nt | aa | nt | aa |
| TCR 31 | E7(11-19) | 407 | 1225 | 687 | 1224 | 696 |
| TCR 32 | E7(11-19) | 408 | 1049 | 705 | 1050 | 714 |
| TCR 33 | E7(11-19) | 409 | 1051 | 722 | 1052 | 731 |
| TCR 34 | E7(11-19) | 410 | 1226 | 737 | 1227 | 746 |
| TCR 35 | E7(11-19) | 411 | 1055 | 755 | 1056 | 764 |
| TCR 36 | E7(11-19) | 412 | 1057 | 771 | 1058 | 777 |
| TCR 37 | E7(11-19) | 413 | 1059 | 783 | 1060 | 789 |
| TCR 38 | E7(11-19) | 414 | 1061 | 795 | 1062 | 804 |
| TCR 39 | E7(11-19) | 415 | 1063 | 811 | 1064 | 820 |
| TCR 40 | E7(11-19) | 416 | 1065 | 826 | 1066 | 835 |
| TCR 41 | E7(11-19) | 417 | 1067 | 841 | 1068 | 847 |
| TCR 42 | E7(11-19) | 418 | 1069 | 853 | 1070 | 859 |
| TCR 43 | E7(11-19) | 419 | 1071 | 865 | 1072 | 871 |
| TCR 44 | E7(11-19) | 420 | 1073 | 877 | 1074 | 883 |
| TCR 45 | E7(11-19) | 421 | 1075 | 891 | 1076 | 897 |
| TCR 46 | E7(11-19) | 422 | 1077 | 904 | 1078 | 913 |
| TCR 47 | E7(11-19) | 423 | 1079 | 921 | 1080 | 927 |
| TCR 48 | E7(11-19) | 424 | 1081 | 933 | 1082 | 941 |
| TCR 49 | E7(11-19) | 425 | 1083 | 947 | 1084 | 953 |
| TCR 50 | E7(11-19) | 426 | 1085 | 959 | 1086 | 965 |
| TCR 51 | E7(11-19) | 427 | 1087 | 971 | 1088 | 977 |
| TCR 52 | E7(11-19) | 428 | 1089 | 983 | 1090 | 989 |
| TCR 53 | E7(11-19) | 429 | 1091 | 995 | 1092 | 1004 |
| TCR 54 | E7(11-19) | 227 | 1093 | 58 | 1094 | 62 |
| TCR 55 | E7(11-19) | 340 | 1095 | 283 | 1228 | 285 |

C. Codon Optimization and Modification

Nucleotide sequences encoding TCRs generated as described above were modified by codon optimization and/or by mutation(s) to promote the formation of a non-native disulfide bond in the interface between the TCR constant domains to increase pairing and stability of the TCR. The non-native disulfide bond was promoted by modifying the TCR chains at residue 48 in the Cα region from Thr to Cys and residue 57 of the Cβ region from Ser to Cys (see Kuball et al. (2007) Blood, 109:2331-2338). The corresponding SEQ ID NO for the resulting modified nucleotide sequences and corresponding encoded amino acid sequences for the modified version of each TCR are shown in Table 23 (E6(29-38)-specific TCR) and Table 24 (E7(11-19)-specific TCRs).

For individual TCRs modified as described above, constructs were generated that contained the modified nucleotide sequences encoding the beta chain and alpha chain, respectively, of the cloned TCRs, separated by a sequence encoding a P2A polypeptide and inserted into a vector, e.g. lentiviral vector, which were used for expressing the TCR chain in T cell lines and primary T cells using standard methods.

TABLE 23

Codon Optimized, Cysteine Modified Version of HPV 16 E6(29-38)-Specific TCRs

| | | SEQ ID NO. of Modified Version of TCR | | | | |
|---|---|---|---|---|---|---|
| | | Full-length | alpha | | beta | |
| TCR | Epitope | nt | nt | aa | nt | aa |
| TCR 15 | E6(29-38) | 432 | 1097 | 474 | 1098 | 480 |
| TCR 16 | E6(29-38) | 433 | 1099 | 489 | 1100 | 495 |
| TCR 17 | E6(29-38) | 434 | 1101 | 501 | 1102 | 495 |
| TCR 18 | E6(29-38) | 435 | 1103 | 507 | 1104 | 513 |
| TCR 19 | E6(29-38) | 436 | 1105 | 519 | 1106 | 527 |
| TCR 20 | E6(29-38) | 437 | 1107 | 533 | 1108 | 542 |
| TCR 21 | E6(29-38) | 438 | 1109 | 551 | 1110 | 557 |
| TCR 22 | E6(29-38) | 439 | 1111 | 566 | 1112 | 575 |
| TCR 23 | E6(29-38) | 440 | 1113 | 584 | 1114 | 590 |
| TCR 24 | E6(29-38) | 441 | 1115 | 596 | 1116 | 602 |
| TCR 25 | E6(29-38) | 442 | 1117 | 608 | 1118 | 614 |
| TCR 26 | E6(29-38) | 443 | 1119 | 620 | 1120 | 626 |
| TCR 27 | E6(29-38) | 444 | 1121 | 634 | 1122 | 640 |
| TCR 28 | E6(29-38) | 445 | 1123 | 646 | 1124 | 652 |
| TCR 29 | E6(29-38) | 446 | 1125 | 658 | 1126 | 664 |
| TCR 30 | E6(29-38) | 447 | 1127 | 673 | 1128 | 682 |

TABLE 24

Codon Optimized, Cysteine Modified Version of HPV 16 E7(11-19)-Specific TCRs

| | | SEQ ID NO. of Modified Version of TCR | | | | |
|---|---|---|---|---|---|---|
| | | Full-length | alpha | | beta | |
| TCR | Epitope | nt | nt | aa | nt | aa |
| TCR 31 | E7(11-19) | 448 | 1129 | 688 | 1130 | 697 |
| TCR 32 | E7(11-19) | 449 | 1131 | 706 | 1132 | 715 |
| TCR 33 | E7(11-19) | 450 | 1133 | 723 | 1134 | 732 |
| TCR 34 | E7(11-19) | 451 | 1135 | 738 | 1136 | 747 |
| TCR 35 | E7(11-19) | 452 | 1137 | 756 | 1138 | 765 |
| TCR 36 | E7(11-19) | 453 | 1139 | 772 | 1140 | 778 |
| TCR 37 | E7(11-19) | 454 | 1141 | 784 | 1142 | 790 |
| TCR 38 | E7(11-19) | 455 | 1143 | 796 | 1144 | 805 |
| TCR 39 | E7(11-19) | 456 | 1145 | 812 | 1146 | 821 |
| TCR 40 | E7(11-19) | 457 | 1147 | 827 | 1148 | 836 |
| TCR 41 | E7(11-19) | 458 | 1149 | 842 | 1150 | 848 |
| TCR 42 | E7(11-19) | 459 | 1151 | 854 | 1152 | 860 |
| TCR 43 | E7(11-19) | 460 | 1153 | 866 | 1154 | 872 |
| TCR 44 | E7(11-19) | 461 | 1155 | 878 | 1156 | 884 |
| TCR 45 | E7(11-19) | 462 | 1157 | 892 | 1158 | 898 |
| TCR 46 | E7(11-19) | 463 | 1159 | 905 | 1160 | 914 |
| TCR 47 | E7(11-19) | 464 | 1161 | 922 | 1162 | 928 |
| TCR 48 | E7(11-19) | 465 | 1163 | 934 | 1164 | 942 |
| TCR 49 | E7(11-19) | 466 | 1165 | 948 | 1166 | 954 |
| TCR 50 | E7(11-19) | 467 | 1167 | 960 | 1168 | 966 |
| TCR 51 | E7(11-19) | 468 | 1169 | 972 | 1170 | 978 |
| TCR 52 | E7(11-19) | 469 | 1171 | 984 | 1172 | 990 |

TABLE 24-continued

Codon Optimized, Cysteine Modified Version of HPV 16 E7(11-19)-Specific TCRs

| | | SEQ ID NO. of Modified Version of TCR | | | | |
|---|---|---|---|---|---|---|
| | | Full-length | alpha | | beta | |
| TCR | Epitope | nt | nt | aa | nt | aa |
| TCR 53 | E7(11-19) | 470 | 1173 | 996 | 1174 | 1005 |
| TCR 54 | E7(11-19) | 471 | 1175 | 59 | 1176 | 63 |
| TCR 55 | E7(11-19) | 472 | 1177 | 284 | 1178 | 286 |

Example 5: Expression and Antigen-Binding of Exemplary E6- and E7-Specific TCRs Exemplary E6- and E7-specific T cell receptors (TCRs), identified as described in Example 4 above, were expressed in T cells and assessed for surface expression and antigen-specific binding, with or without CD8 interaction substantially as described in Example 2 above. Specifically, CD4+ Jurkat-derived cells that did not express endogenous TCR on their surfaces, that either had or had not been modified by introduction of exogenous CD8 (modification resulting in CD4+/CD8+ cells), were mixed in a 1:1 mixture for transfection with plasmid DNA encoding the TCRs, to assess CD8-independent binding activity of the TCRs. For transfection, the CD4+ and CD4+/CD8+ cell mixtures were transiently transfected with TCR-encoding plasmids and 48 hours after transfection, cells were assessed by flow cytometry for (1) binding of the target peptide in the context of an MHC molecule (HLA:A02:01) by staining with an E6(29-38) peptide- or an E7(11-19) peptide-MHC tetramer reagent, and/or (2) CD8+ independent binding of the target by co-staining the tetramer-labeled cells with an anti-CD8 antibody. Cells that had been mock transfected (mock) and cells expressing a reference TCR capable of binding to HLA-A2/E6(29-38) also were assessed in this study.

Figure 5A:
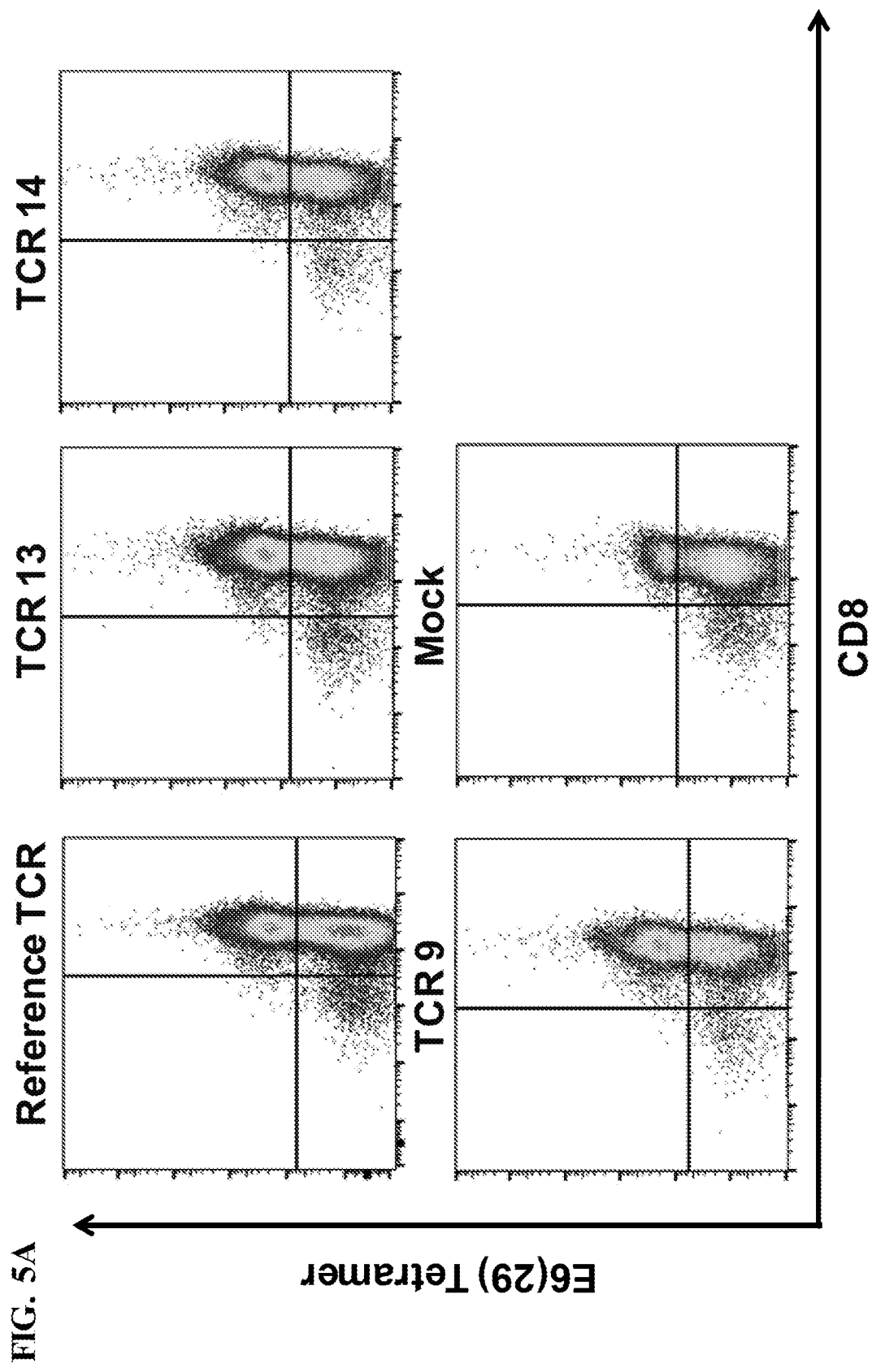
FIGS. 5A-5C show flow cytometry results for tetramer binding and in Jurkat-derived cell line that also expresses exogenous CD8 and various E6(29-38)-specific TCRs, in CD8+ cells. Results are shown for TCR 9, TCR13, TCR14, a reference TCR capable of binding to HLA-A2/E6(29-38) (Reference TCR) and cells that had been mock transfected (mock) (FIG. 5A); TCR 17, TCR 21, TCR 22, Reference TCR and Mock (FIG. 5B); and TCR 18, TCR 23, TCR 24 and TCR 27 (FIG. 5C).
Figure 5B:
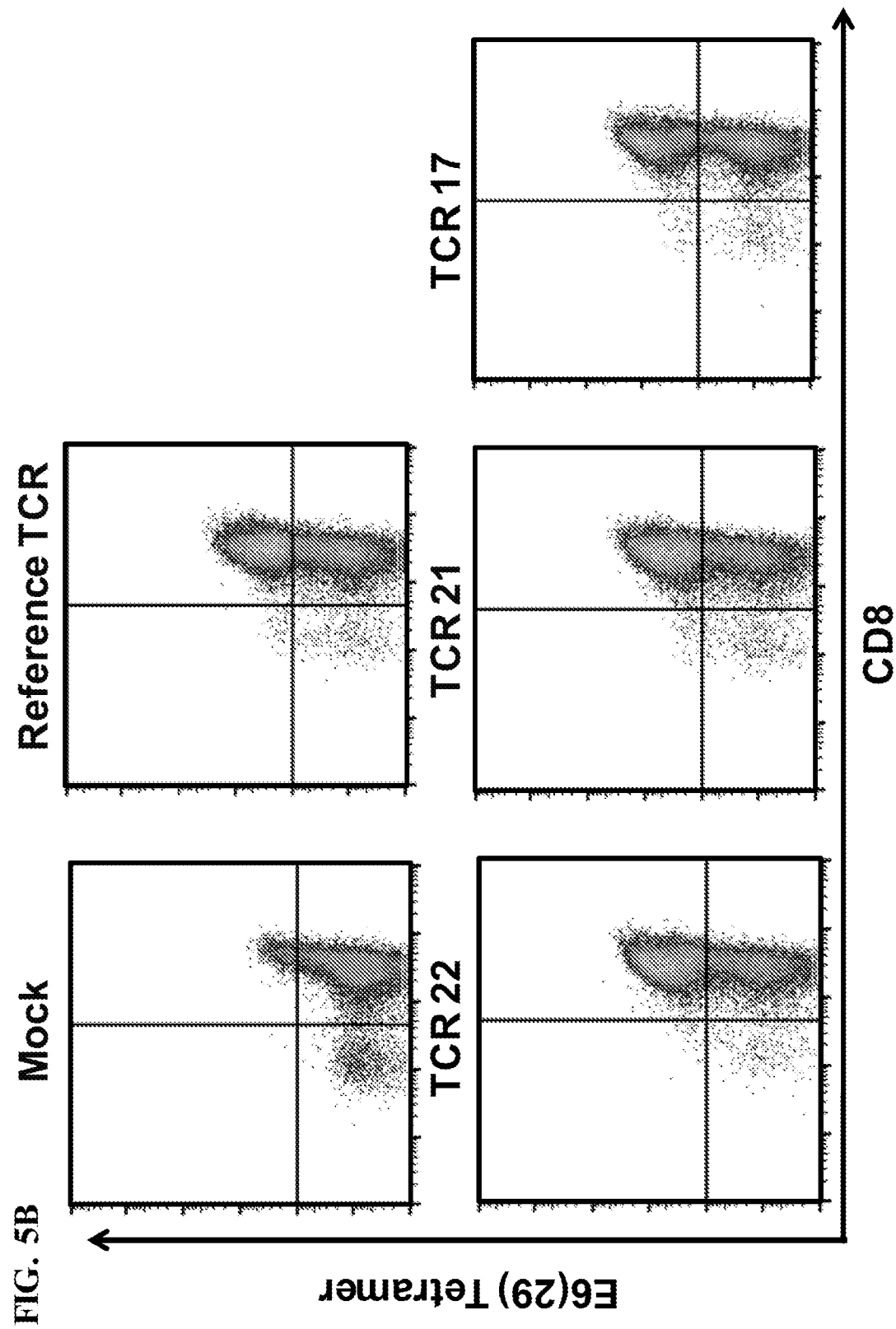
Figure 5C:
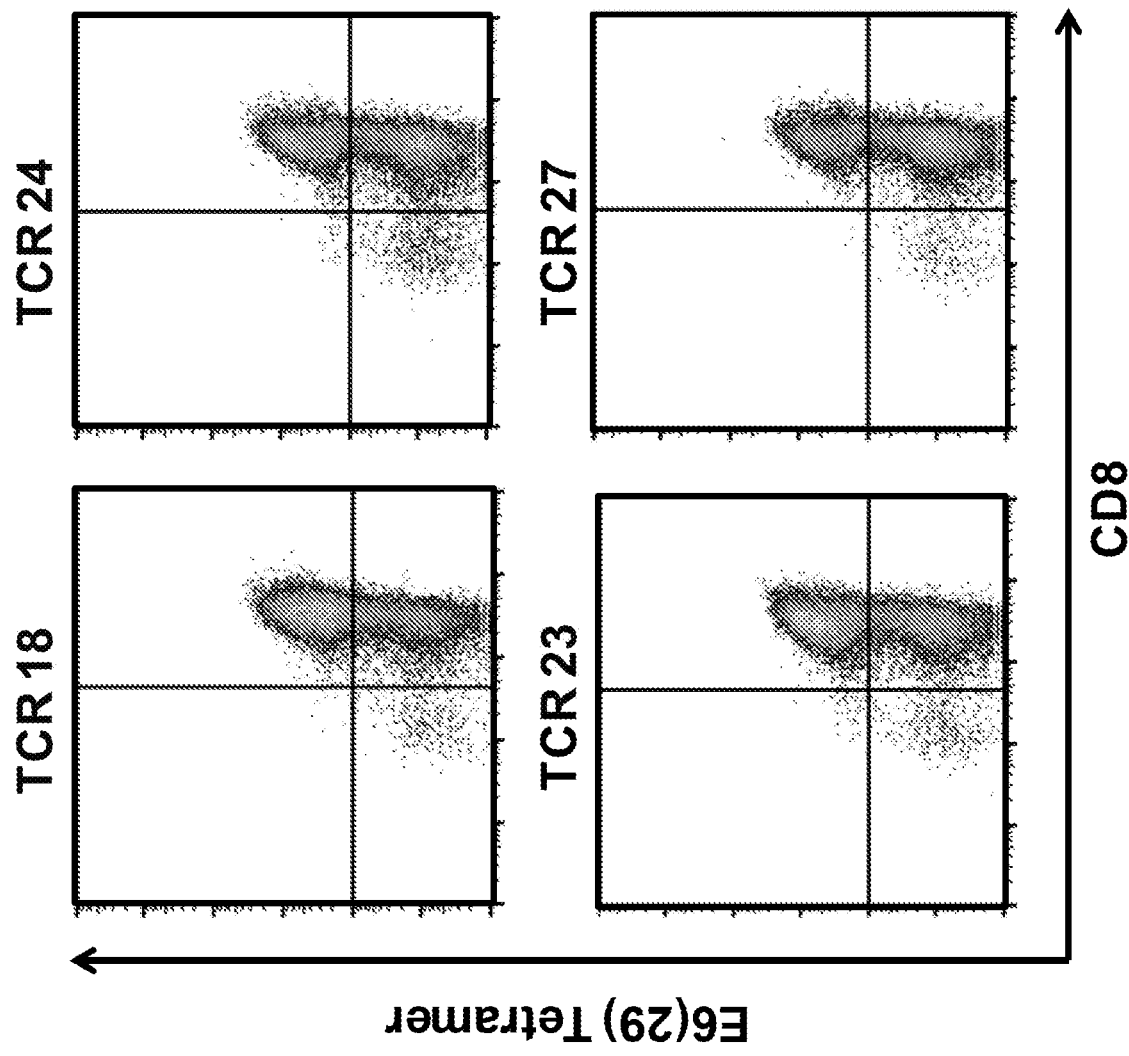
Figure 5D:
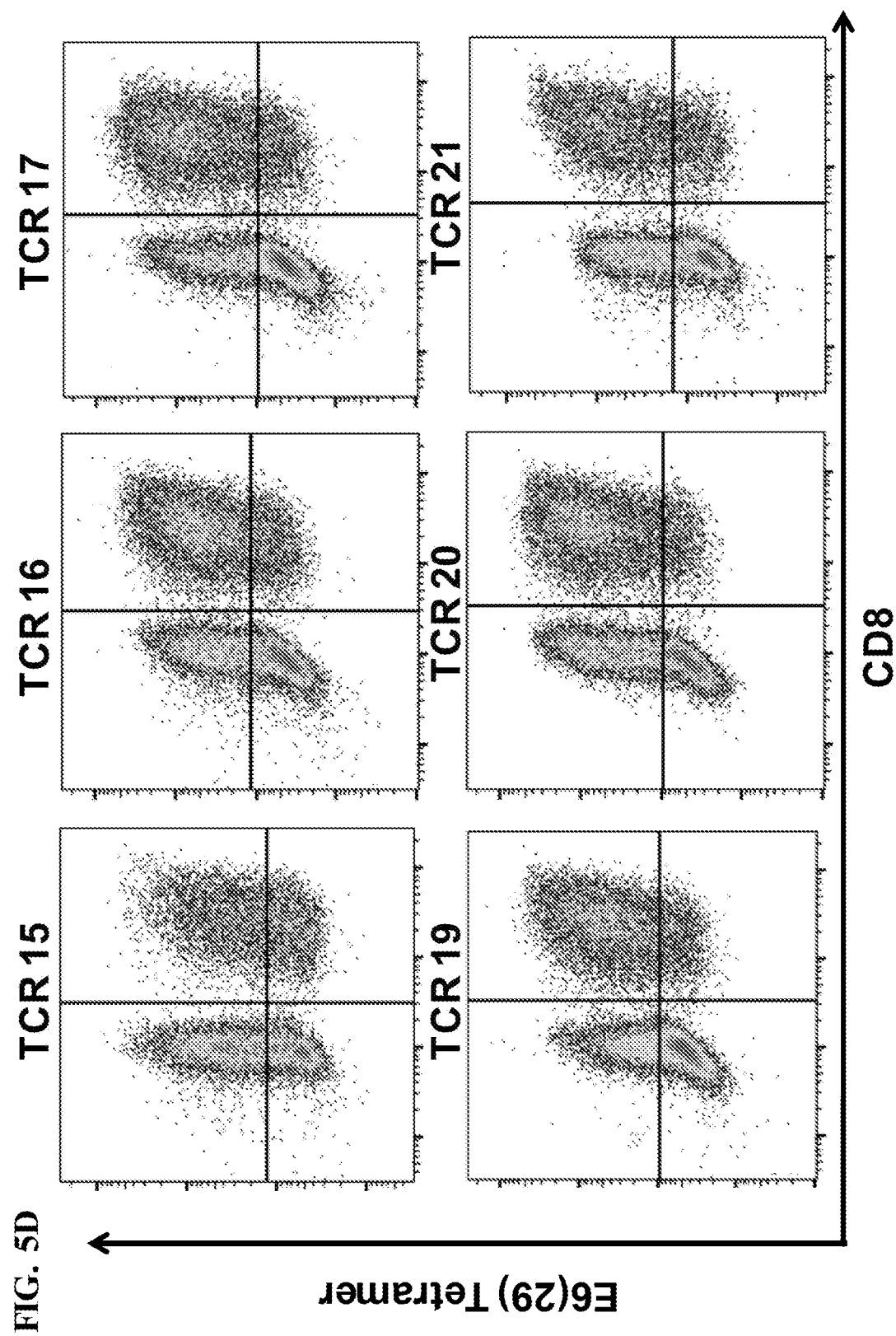
FIGS. 5D-5F show flow cytometry results for tetramer binding and in Jurkat-derived cell line that also expresses exogenous CD8 and various E6(29-38)-specific TCRs. Results are shown for TCR 15, TCR 16, TCR 17, TCR 19, TCR 20 and TCR 21 (FIG. 5D); TCR 18, TCR 23, TCR 24, TCR 27 and TCR 28 (FIG. 5E); and TCR 25, TCR 26, TCR 29 and TCR 30 (FIG. 5F).
Figure 5E:
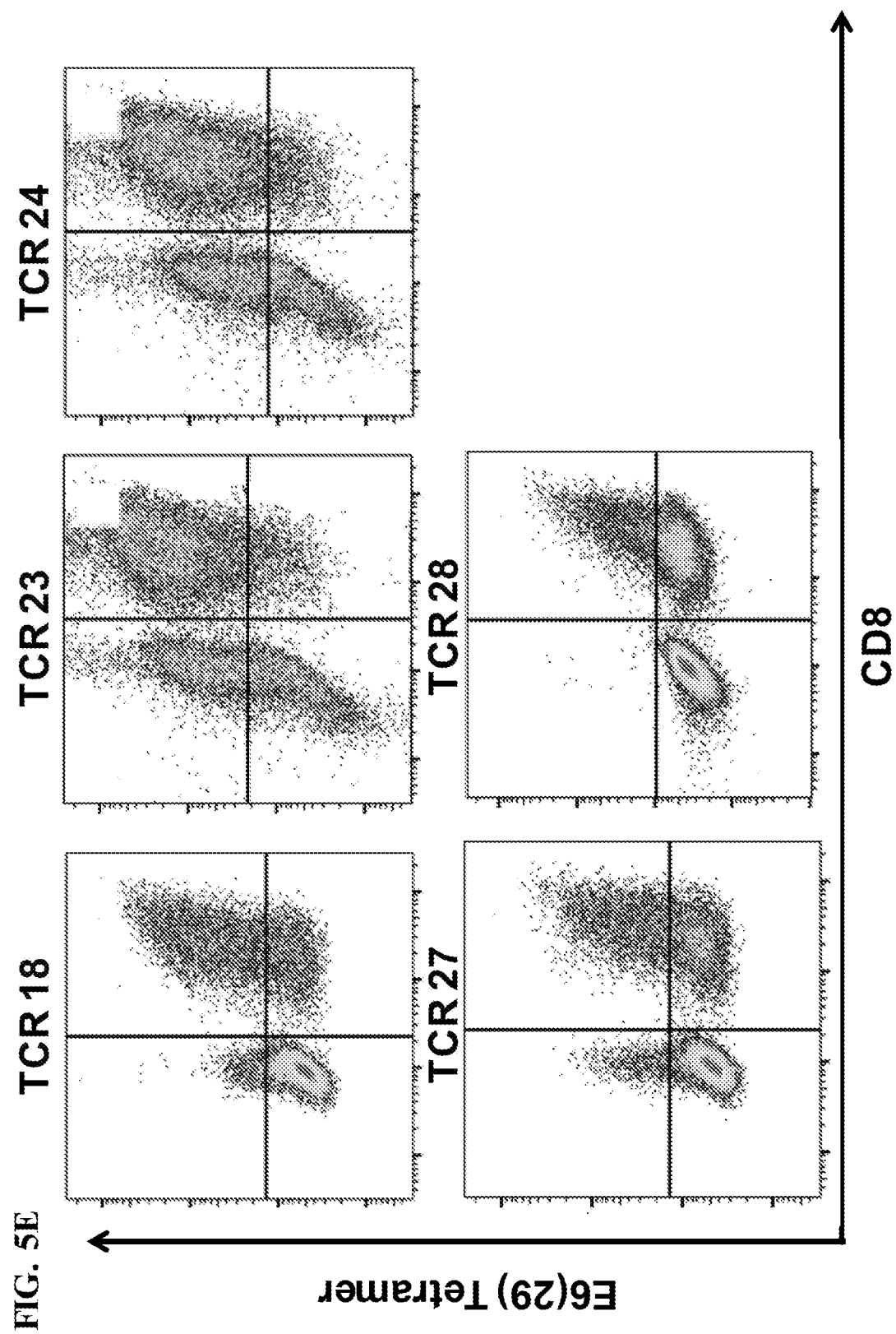
Figure 5F:
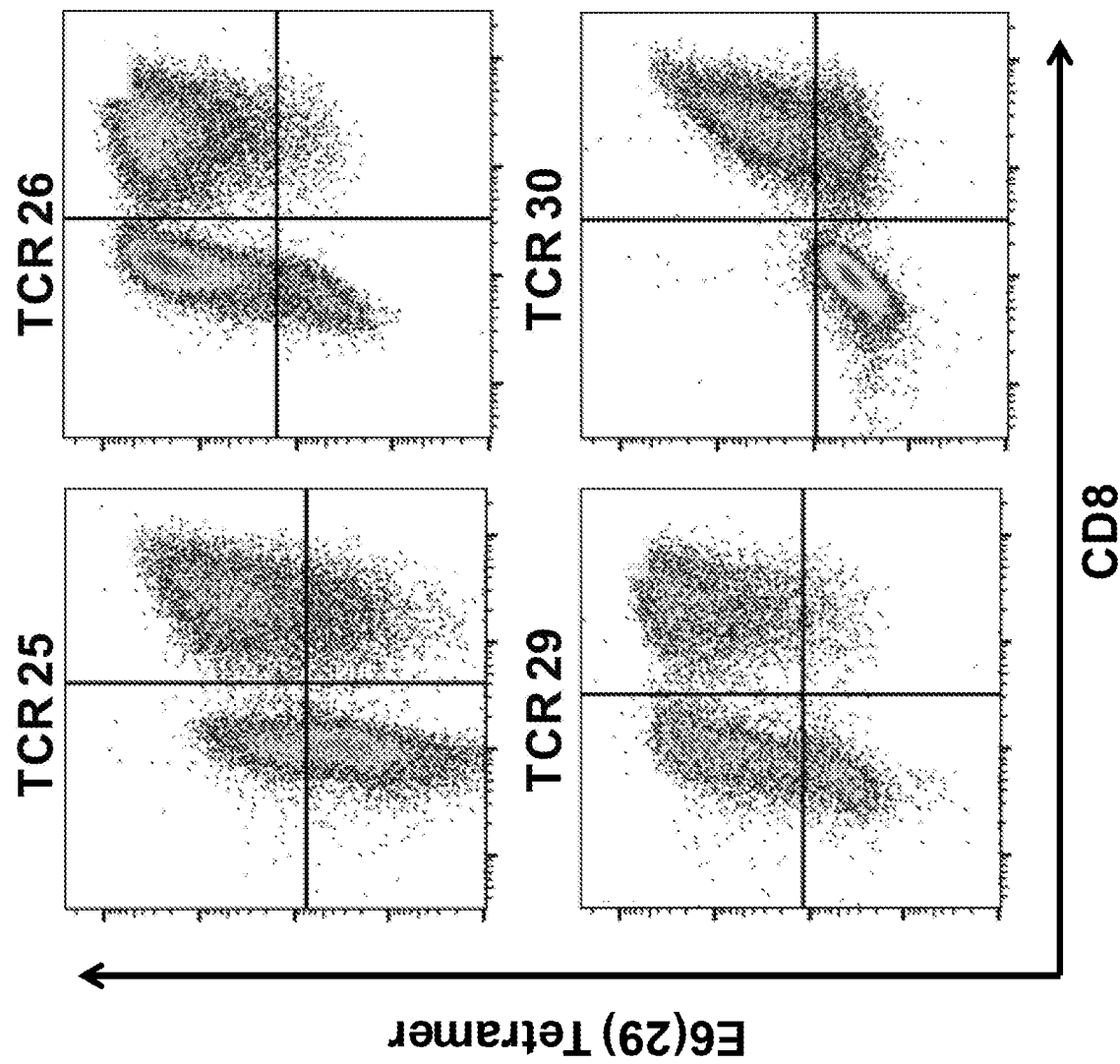
Figure 6A:
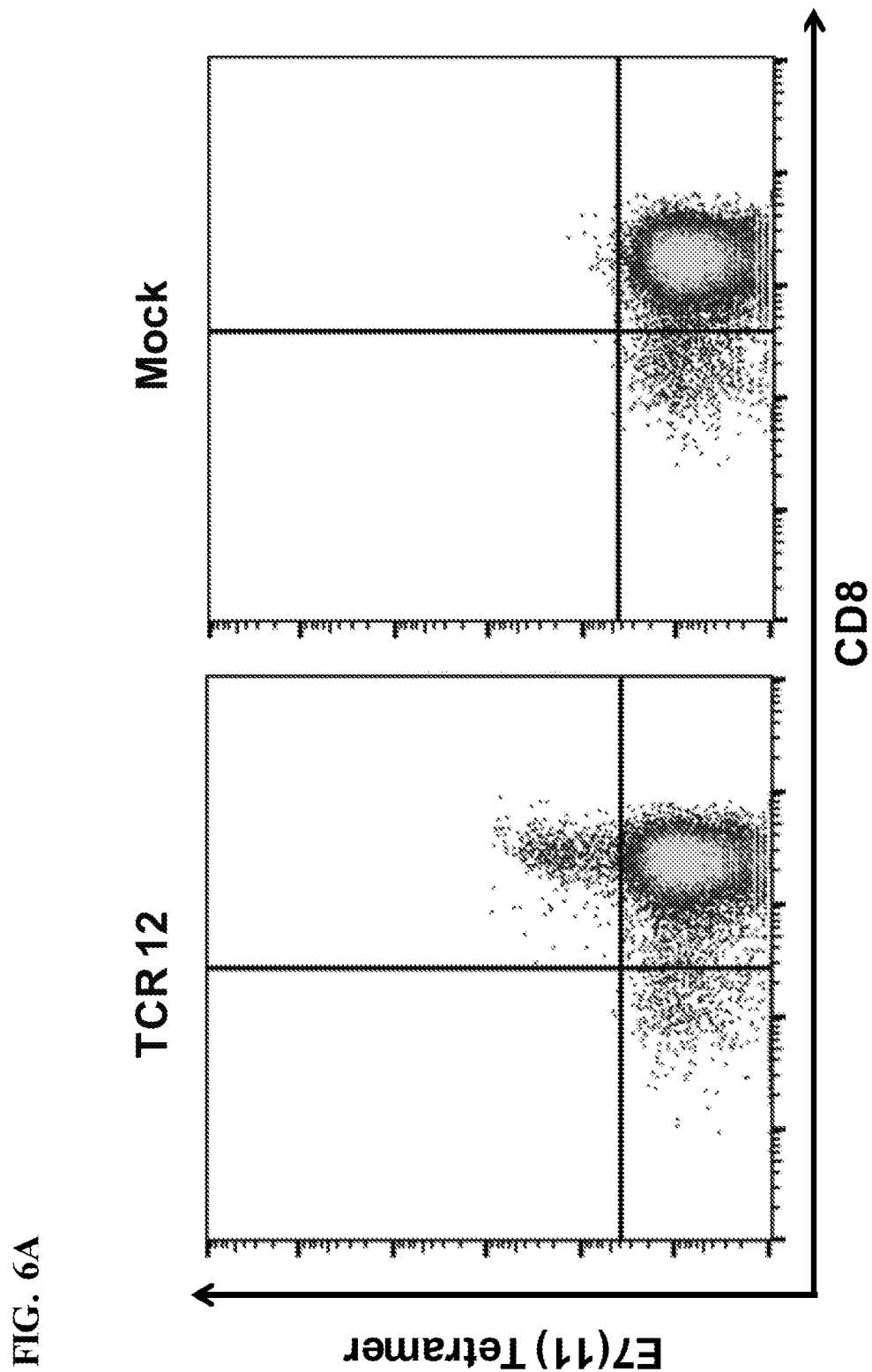
FIGS. 6A-6F show flow cytometry results for tetramer binding and in Jurkat-derived cell line that also expresses exogenous CD8 and various E7(11-19)-specific TCRs. Results are shown for TCR 12 and cells that had been mock transfected (mock) (FIG. 6A); TCR 31, TCR 32, TCR 33 and TCR 34 (FIG. 6B); TCR 12, TCR 49, TCR 50 and TCR 51 (FIG. 6C); TCR 35, TCR 36, TCR 37, TCR 38, TCR 53 and TCR 54 (FIG. 6D); TCR 39, TCR 40, TCR 41, TCR 42, TCR 43 and TCR 44 (FIG. 6E); and TCR 45, TCR 46, TCR 47, TCR 48, TCR 54 and TCR 55 (FIG. 6F).
Figure 6B:
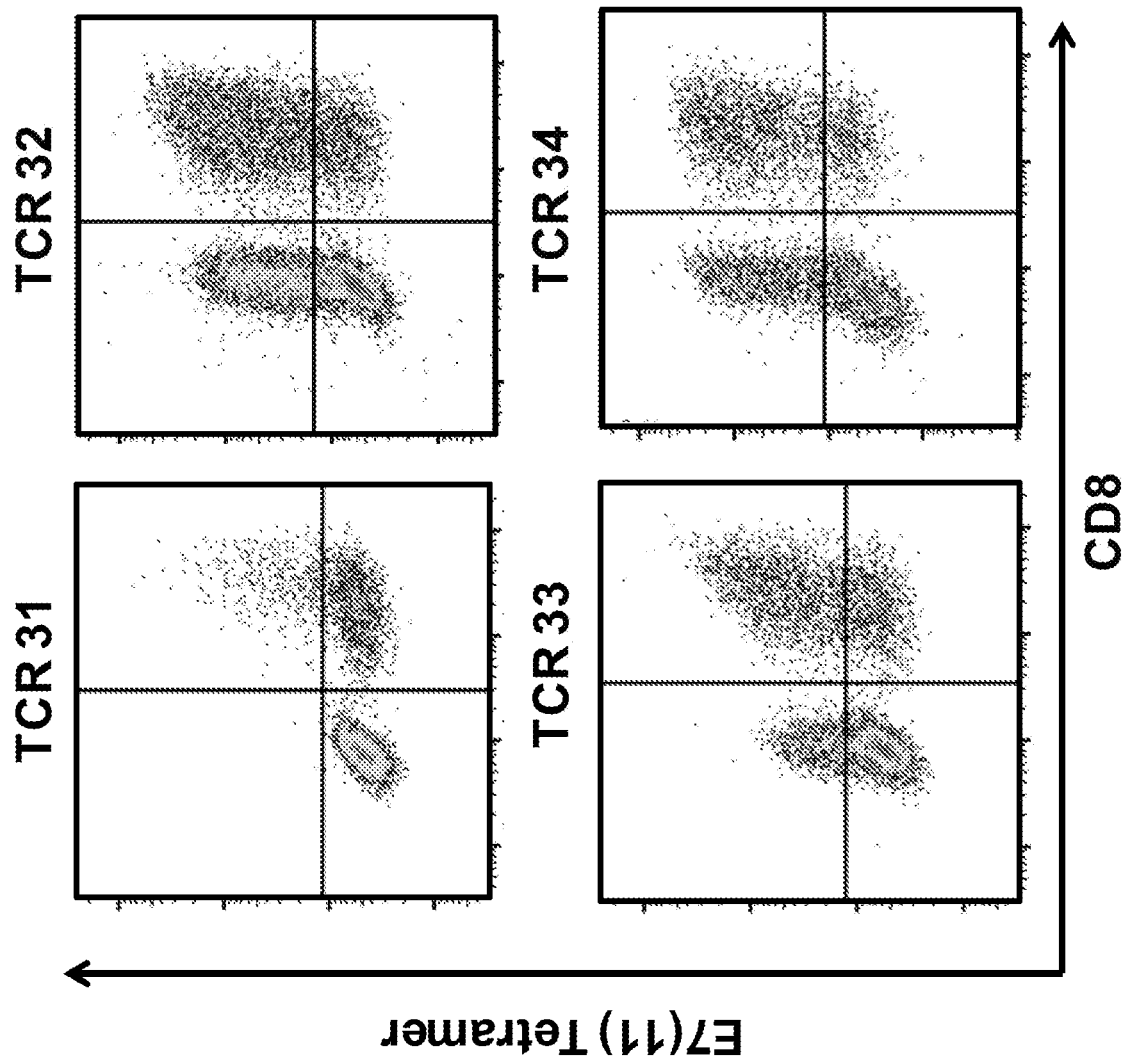
Figure 6C:
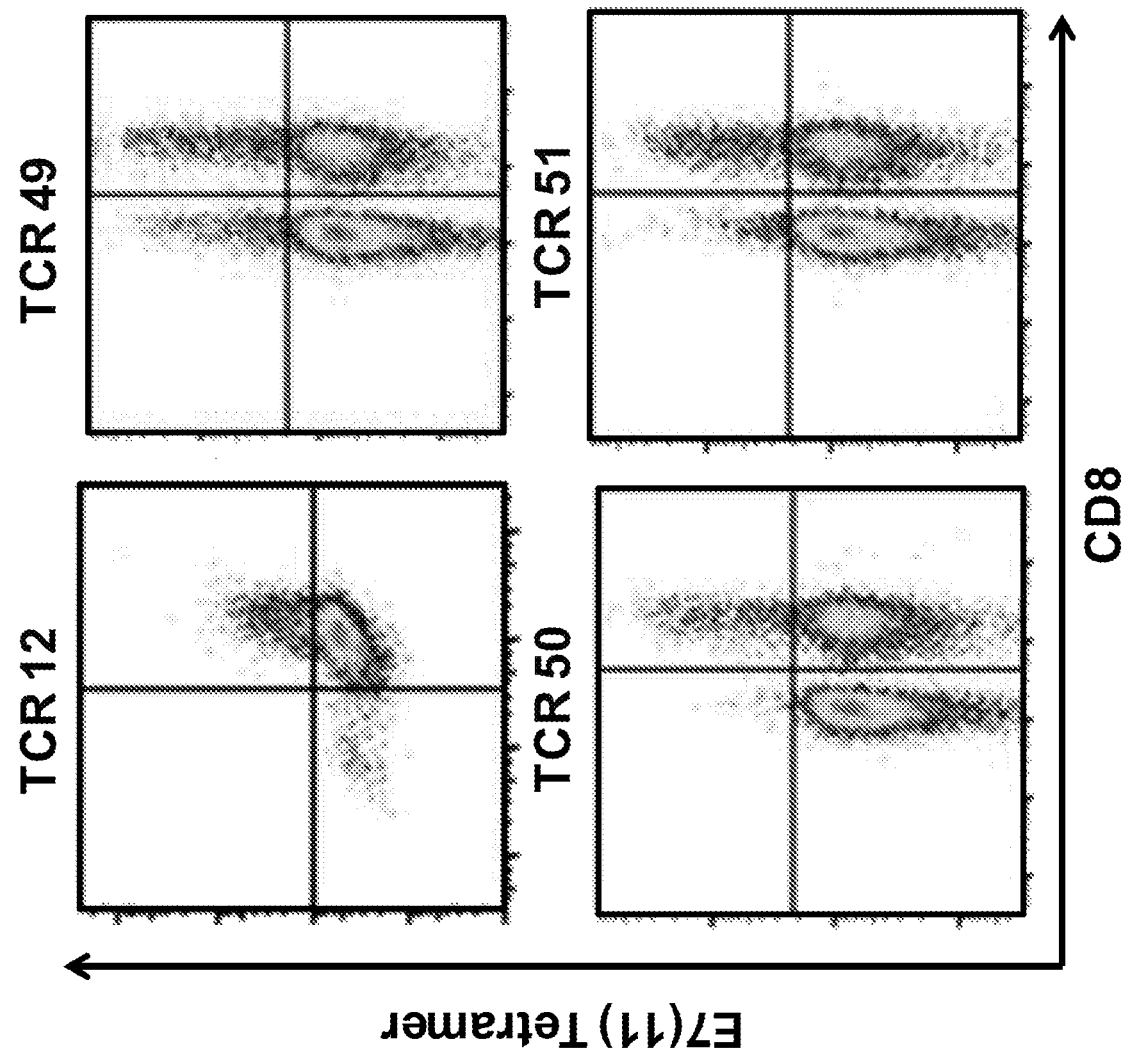
Figure 6D:
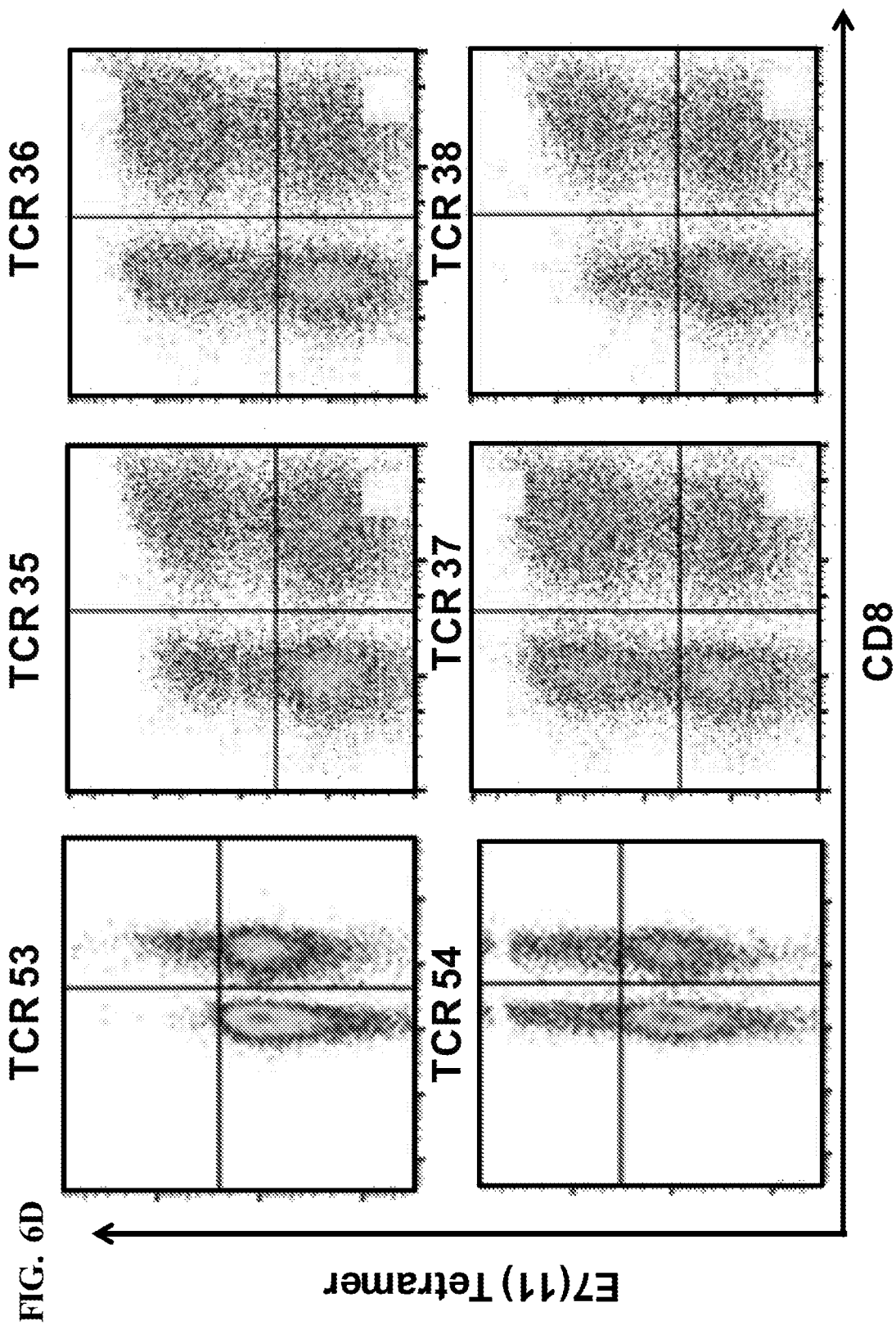
Figure 6E:
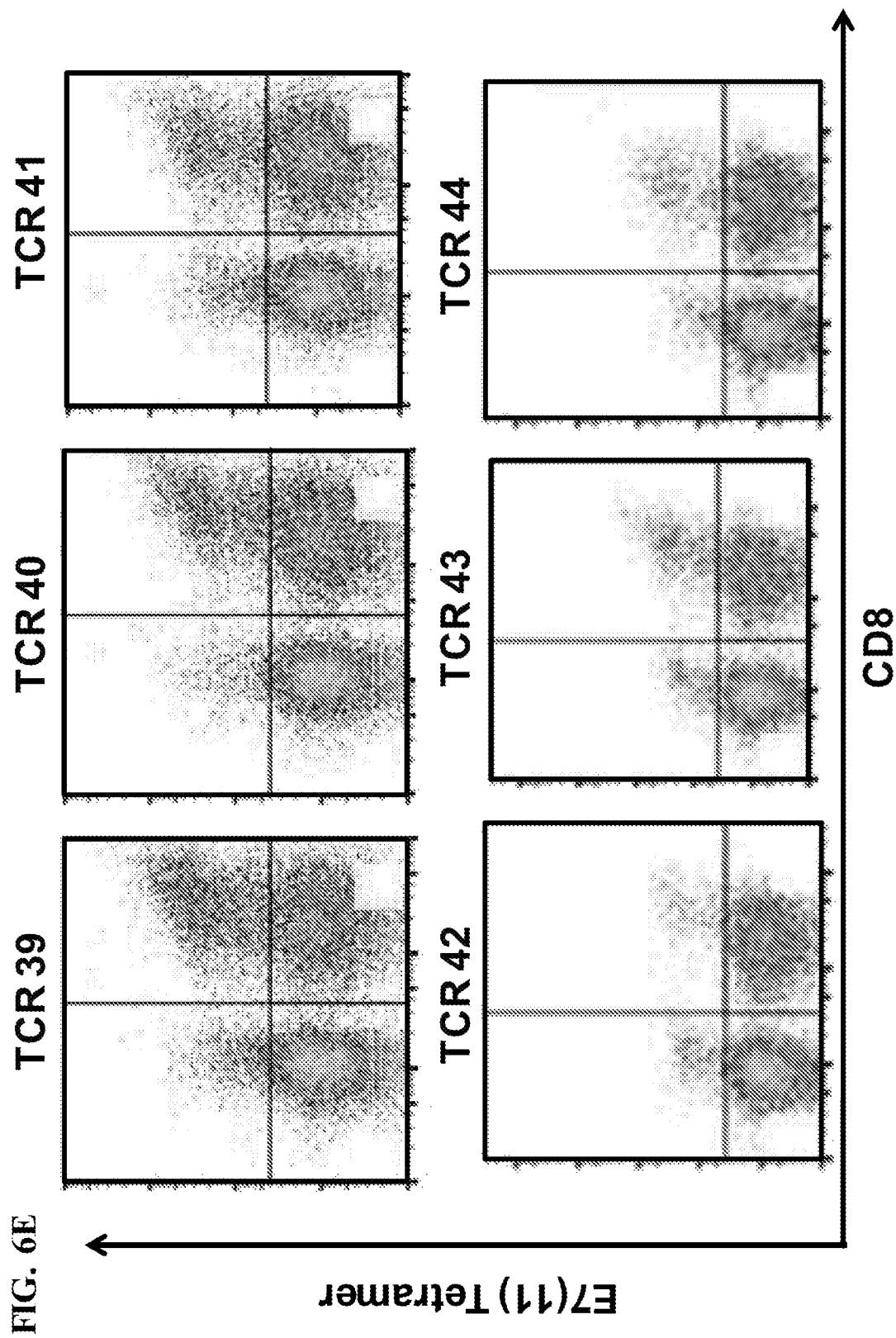
Figure 6F:
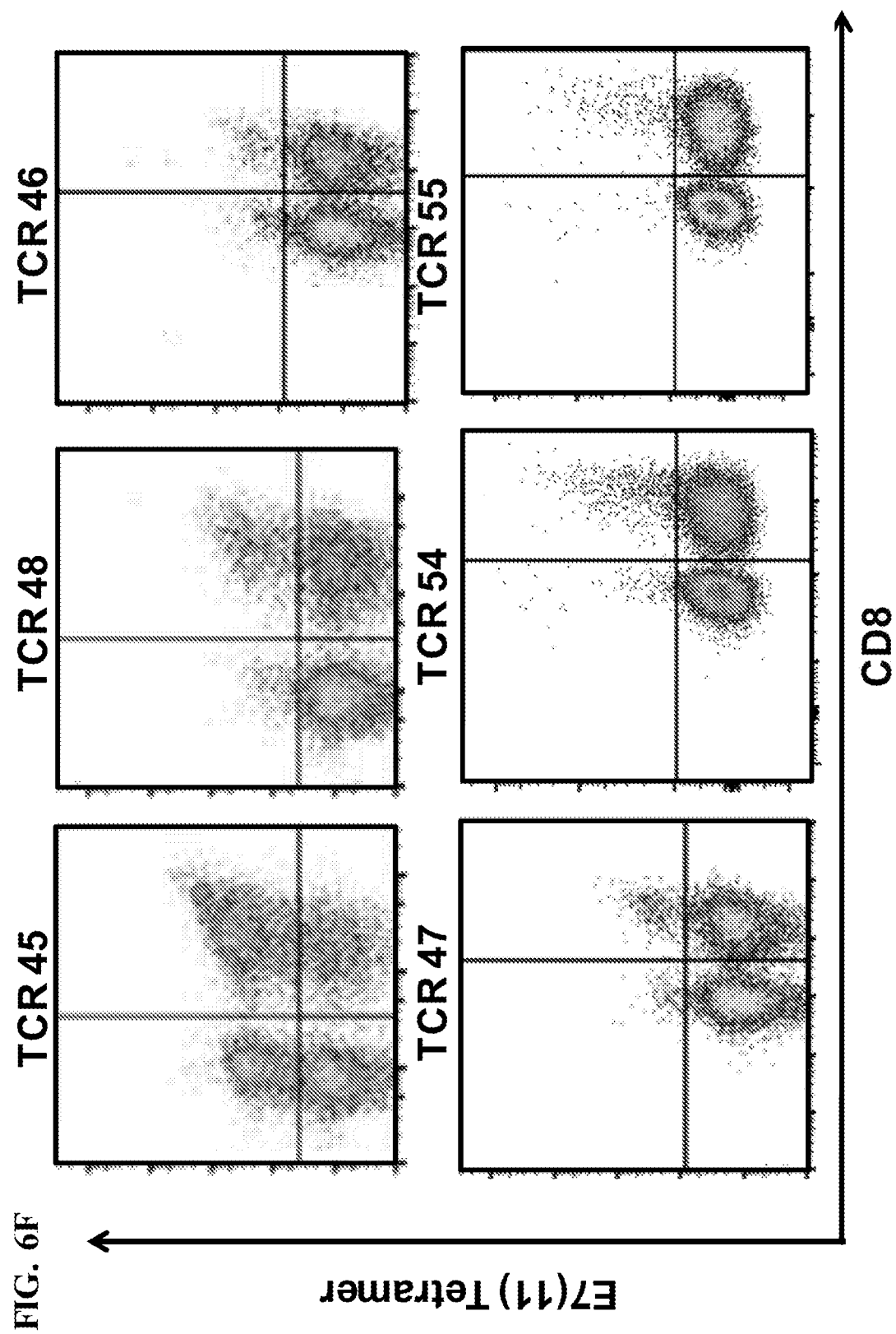

Exemplary results are shown in FIGS. 5A-5F (E6(29-38)-loaded tetramer binding) and FIGS. 6A-6F (E7 (11-19)-loaded tetramer binding). The percentage of cells in the indicated quadrants in flow cytometry plots shown in FIGS. 5A-5H and 6A-6H are also summarized below in Table 25 (flow cytometry plots showing E6(29) tetramer and CD8+ staining results for CD8+ cells from TCR-transfected compositions; FIGS. 5A-5C), Table 26 (flow cytometry plots showing results for E6(29)-specific TCR-transfected cell compositions; FIGS. 5D-5F) and Table 27 (flow cytometry plots showing results for E7(11)-specific TCRs; FIG. 6A-6F). Specifically, FIGS. 5A-5C depict flow cytometry plots for tetramer and CD8 staining in CD8+ populations; FIGS. 5D-5F and 6A-6F depict plots reflecting staining of CD8+ and CD8- populations.

TABLE 25

Percentage of cells present in each indicated quadrant in Flow Cytometry Plots Shown in FIGS. 5A-5C

| E6 TCRs | E6 tet+/CD8− quadrant | E6 tet+/CD8+ quadrant | E6 tet−/CD8+ quadrant | E6 tet−/CD8− quadrant |
|---|---|---|---|---|
| Mock | 0.046 | 12.5 | 83.7 | 3.75 |
| Reference TCR | 0.07 | 32 | 65.9 | 1.95 |
| TCR 9 | 0.051 | 42.5 | 55.6 | 1.89 |

TABLE 25-continued

Percentage of cells present in each indicated quadrant in Flow Cytometry Plots Shown in FIGS. 5A-5C

| E6 TCRs | E6 tet+/CD8− quadrant | E6 tet+/CD8+ quadrant | E6 tet−/CD8+ quadrant | E6 tet−/CD8− quadrant |
|---|---|---|---|---|
| TCR 13 | 0.064 | 38.6 | 59.5 | 1.82 |
| TCR 14 | 0.04 | 38.4 | 59.7 | 1.8 |
| Mock | 5.85E−03 | 4.44 | 88.9 | 6.64 |
| Reference TCR | 0.16 | 40 | 57.9 | 1.93 |
| TCR 17 | 0.17 | 34.7 | 63.6 | 1.53 |
| TCR 18 | 0.045 | 50.4 | 47.7 | 1.86 |
| TCR 21 | 0.22 | 51.6 | 46 | 2.18 |
| TCR 22 | 0.14 | 51.2 | 47.3 | 1.38 |
| TCR 23 | 0.18 | 43.6 | 54.1 | 2.14 |
| TCR 24 | 0.13 | 29.1 | 66.2 | 4.51 |
| TCR 27 | 0.02 | 24.5 | 73.5 | 1.96 |

TABLE 26

Percentage of cells present in each indicated quadrant in flow cytometry plots in FIGS. 5D-5F

| E6 TCRs | E6 tet+/CD8− quadrant | E6 tet+/CD8+ quadrant | E6 tet−/CD8+ quadrant | E6 tet−/CD8− quadrant |
|---|---|---|---|---|
| TCR 15 | 40.2 | 21.4 | 13.6 | 24.8 |
| TCR 16 | 28.2 | 35.6 | 9.51 | 26.7 |
| TCR 17 | 21.3 | 36.2 | 7.72 | 34.8 |
| TCR 18 | 3.61 | 23.3 | 12 | 61.1 |
| TCR 19 | 20.8 | 35.5 | 7.71 | 36 |
| TCR 20 | 34.1 | 38.2 | 5.17 | 22.6 |
| TCR 21 | 32.7 | 28.8 | 7.16 | 31.3 |
| TCR 23 | 22.5 | 52.5 | 5.19 | 19.7 |
| TCR 24 | 23.5 | 55 | 5.56 | 16 |
| TCR 25 | 14.7 | 34 | 10.2 | 41.1 |
| TCR 26 | 47.4 | 42.3 | 1.58 | 8.73 |
| TCR 27 | 3.5 | 15.8 | 20.1 | 60.6 |
| TCR 28 | 0.15 | 13.1 | 31.4 | 55.4 |
| TCR 29 | 44.5 | 35.6 | 2 | 17.9 |
| TCR 30 | 0.74 | 31 | 13.9 | 54.3 |

TABLE 27

Percentage of cells identified in each indicated quadrant in flow cytometry plots in FIGS. 6A-6F

| E7 TCRs | E7 tet+/CD8− quadrant | E7 tet+/CD8+ quadrant | E7 tet−/CD8+ quadrant | E7 tet−/CD8− quadrant |
|---|---|---|---|---|
| Mock | 0.01 | 0.1 | 96.1 | 3.77 |
| TCR 12 | 8.48E−03 | 1.89 | 96.2 | 1.86 |
| TCR 12 | 0.001 | 18.6 | 78.6 | 2.82 |
| TCR 31 | 0.042 | 4.52 | 21.1 | 74.3 |
| TCR 32 | 33.5 | 25.3 | 7.53 | 33.7 |
| TCR 33 | 14 | 22.6 | 12.8 | 50.6 |
| TCR 34 | 26 | 26.3 | 6.85 | 40.9 |
| TCR 35 | 7.18 | 14.5 | 35.1 | 43.2 |
| TCR 36 | 16.7 | 23.4 | 25.4 | 34.5 |
| TCR 37 | 19.5 | 25.5 | 22.7 | 32.2 |
| TCR 38 | 5.44 | 15.7 | 33.3 | 45.5 |
| TCR 39 | 2.61 | 12.3 | 37 | 48 |
| TCR 40 | 1.37 | 7.84 | 42.4 | 48.4 |
| TCR 41 | 2.41 | 6.07 | 43.6 | 47.9 |
| TCR 42 | 1.65 | 1.21 | 39.5 | 57.4 |
| TCR 43 | 1.88 | 3.82 | 37.6 | 56.7 |
| TCR 44 | 1.43 | 2.96 | 39.9 | 55.7 |
| TCR 45 | 16.9 | 22.4 | 19.5 | 41.3 |
| TCR 46 | 1.21 | 1.27 | 38.9 | 58.6 |
| TCR 47 | 0.71 | 1.98 | 40.6 | 56.7 |
| TCR 48 | 1.29 | 5.36 | 37 | 56.4 |

TABLE 27-continued

Percentage of cells identified in each indicated quadrant in flow cytometry plots in FIGS. 6A-6F

| E7 TCRs | E7 tet+/CD8− quadrant | E7 tet+/CD8+ quadrant | E7 tet−/CD8+ quadrant | E7 tet−/CD8− quadrant |
|---|---|---|---|---|
| TCR 49 | 3.06 | 5.54 | 27.2 | 64.3 |
| TCR 50 | 0.25 | 3.28 | 30.7 | 65.8 |
| TCR 51 | 2.06 | 5.7 | 27.5 | 64.7 |
| TCR 53 | 0.43 | 3.35 | 28.7 | 67.5 |
| TCR 54 | 11.3 | 9.66 | 21.2 | 57.6 |
| TCR 54 | 0.63 | 2.75 | 48.3 | 48.3 |
| TCR 55 | 0.28 | 1.45 | 50.4 | 47.9 |

As shown, the exemplary assessed TCRs were expressed on the surface of T cells and recognized HPV peptide in the context of MHC tetramers. In some cases, the binding was independent of CD8 co-receptor, as indicated by tetramer+ cells in the CD8− population in FIGS. 5D-5F (percentages listed in Table 26) and FIGS. 6A-6F (percentages listed in Table 27).

Example 6: Expression and Assessment of Exemplary Recombinant T Cell Receptors (TCRs) in Primary T Cells Expression and function of exemplary recombinant E7-specific TCRs in primary human T cells was assessed.

Primary human CD4+ and CD8+ T cells were transduced with lentiviral preparations encoding TCR 16, specific for HPV 16 E6(29-38); and TCR 49, TCR 53 and TCR 37, each specific for HPV 16 E7(11-19) (described above in Example 4 above). Approximately $5 \times 10^6$ primary human CD4+ and CD8+ T cells were isolated by immunoaffinity-based selection from human peripheral blood mononuclear cells (PBMCs) obtained from healthy donors. The cells were stimulated for 24 hours by culturing with an anti-CD3/anti-CD28 reagent in media containing human serum and cytokines, at 37° C. prior to lentiviral transduction. Stimulated cells were transduced with a lentiviral preparation encoding TCR 16, TCR 49, TCR 53 or TCR 37, or a mock transduction control (cells treated under the same conditions used for lentiviral transduction but without addition of lentivirus). The lentiviral constructs also contained sequences encoding EGFRt as a surrogate marker for transduction and expression, separated from the recombinant TCR encoding sequences by a sequence encoding a T2A ribosome skip sequence. Following transduction, the cells were cultured in media containing human serum and cytokines. On day 13 after transduction, the cells were assessed by flow cytometry for staining with an anti-CD3 antibody, an anti-CD8 antibody, and a HPV 16 E6(29-38)- or HPV16 E7(11-19)-peptide-MHC tetramer complex. (interferon-gamma (IFNγ) production was assessed following incubation of recombinant TCR-expressing cells with a squamous cell carcinoma cell line UPCI:SCC152 (ATCC® CRL-3240™), an antigen-specific target cell line which is HPV+, at an E:T ratio of 7.5:1 or 3.25:1 for TCR 16-expressing cells, and E:T ratio of 2.5:1 for TCR 49-, TCR 53- or TCR 37-expressing cells.

The results showed binding of the respective peptide-MHC tetramer complex specific for each TCR. TCR 16-expressing cells produced IFNγ at levels above background at both E:T ratios tested. CD8+ cells expressing TCR 49, TCR 53 or TCR 37 produced IFNγ at levels above background, and CD4+ cells expressing TCR 53 and TCR 37 produced IFNγ at levels above background, consistent with CD8-independent function of these TCRs in primary T cells. The results are consistent with expression, cell surface expression and antigen-specific function of the recombinant TCRs in primary T cells.

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

SEQUENCE TABLE

| SEQ ID NO. | SEQUENCE | DESCRIPTION |
|---|---|---|
| 1 | MGIRLLCRVAFCFLAVGLVDVKVTQSSRYLVKRTGEKVFLECVQDMDHENMF WYRQDPGLGLRLIYPSYDVMKEKGDIPEGYSVSREKKERFSLILESASTNQTSM YLCASTFWGQRTEAFFGQGTRLTVVEDLNKVFPPEVAVFEPSEAEISHTQKATL VCLATGFFPDHVELSWWVNGKEVHSGVCTDPQPLKEQPALNDSRYCLSSRLRV SATFWQNPRNHFRCQVQFYGLSENDEWTQDRAKPVTQIVSAEAWGRADCGFTS VSYQQGVLSATILYEILLGKATLYAVLVSALVLMAMVKRKDFGSSGATNFSLLKQ AGDVEENPGPMEKNPLAAPLLILWFHLDCVSSILNVEQSPQSLHVQEGDSTNFTC SFPSSNFYALHWYRWETAKSPEALFVMTLNGDEKKKGRISATLNTKEGYSYLYI KGSQPEDSATYLCASQTGANNLFGTGTRLTVIPYIQNPDPAVYQLRDSKSSDKS VCLFTFDSQTNVSQSKDSDVYITDKCVLDMRSMDFKSNSAVAWSNKSDFACA NAFNNSIIPEDTFFPSPESSCDVKLVEKSFETDTNLNFQNLSVIGFRILLLKVAGFN LLMTLRLWSS | TCR 14 Full sequence Cysteine-modified Homo sapiens (aa) |
| 2 | MGTRLLCWVLGFLGTDHTGAGVSQSPRYKVAKRGQDVALRCDPISGHVSLF WYQQALGQGPEFLTYFQNEAQLDKSGLPSDRFFAERPEGSVSTLKIQRTQQEDS AVYLCASSPTGTERELFFGEGSRLTVLEDLKNVFPPEVAVFEPSEAEISHTQKATL VCLATGFYPDHVELSWWV NGKEVHSGVCTDPQPLKEQPALNDSRYCLSSRLRVSATFWQNPRNHFRCQVQF YGLSENDEWTQDRAKPVTQIVSAEAWGRADCGFTSESYQQGVLSATILYEILLG KATLYAVLVSALVLMAMVKRKDSRGGSGATNFSLLKQAGDVEENPGPMLLLL VPVLEVIFTLGGTRAQSVTQLDSHVSVSEGTPVLLRCNYSSSYSPSLFWYVQHPN KGLQLLLKYTSAATLVKGINGFEAEFKKSETSFHLTKPSAHMSDAAEYFCVVRG GKLIFGQGTELSVKPNIQNPDPAVYQLRDSKSVCLFTDFDSQTNVSQSKDS DVYITDKCVLDMRSMDFKSNSAVAWSNKSDFACANAFNNSIIPEDTFFPSPESSC DVKLVEKSFETDTNLNFQNLSVIGFRILLLKVAGFNLLMTLRLWSS | TCR 13 Full sequence Cysteine-modified Homo sapiens (aa) |
| 3 | MDTWLVCWAIFSLLKAGLTEPEVTQTPSHQVTQMGQEVILRCVPISNHLYFYWY RQILGQKVEFLVSFYNNEISEKSEIFDDQPSVERPDGSNFTLKIRSTKLEDSAMYF CASTTRSSYEQYFGPGTRLTVTEDLKNVPPEVAVFEPSEAEISHTQKATLVCLA TGFYPDHVELSWWVNGKEVHSGVCTDPQPLKEQPALNDSRYCLSSRLRVSATF WQNPNHFRCQVQFYGLSENDEWTQDRAKPVTQIVSAEAWGRADCGFTSESY QQGVLSATILYEILLGKATLYAVLVSALVLMAMVKRKDSRGGSGATNFSLLKQ AGDVEENPGPMKTFAGFSFLFLWLQLDCMSRGEDVEQSLFLSVREGDSSVINCT YTDSSSTYLYWYKQPPGAGLQLLTYIFSNMDMKQDQRLTVLLNKKDKHLSLRI ADTQTGDSAIYFCAVPSGAGNKLIFGTGTLLAVQPNIQNPDPAVYQLRDSKSSDK SVCLFTDFDSQTNVSQSKDSDVYITDKCVLDMRSMDFKSNSAVAWSNKSDFAC ANAFNNSIIPEDTFFPSPESSCDVKLVEKSFETDTNLNFQNLSVIGFRILLLKVAGF NLLMTLRLWSS | TCR 12/ TCR 55 Full sequence Cysteine-modified Homo sapiens (aa) |
| 4 | GGCTCCGGCGCCACAAACTTTCTCTGCTGAAGCAGGCAGGCGATGTGGAGG AGAACCCTGGACCA | TCR 14 P2A Artificial (nt) |

| SEQ ID NO. | SEQUENCE | DESCRIPTION |
|---|---|---|
| 5 | GGAAGCGGAGCCACCAACTTTCCCTGCTGAAGCAGGCCGGCGATGTGGAG GAGAATCCTGCCCCA | TCR 13 P2A Artificial (nt) |
| 6 | GGATCTGGAGCCACCAACTTCTCCCTGCTGAAGCAGGCCGGCGATGTGGAGG AGAATCCTGCCCCA | TCR 12 P2A Artificial (nt) |
| 7 | ATGGGCATCCGGCTGCTGTGCAGAGTGGCCTTCTGTTTTCTGGCCGTGGGCCT GGTGACGTGAAGTGACCCAGACTCCAGAGCTCCGGTATCTGGTGAAGAGAACAGG CGAGAAGGTGTTTCTGGAGTGCGTCCAGGACATGGATCACGAGAACATGTTC TGGTACAGACAGGATCCAGGGCTGGGCCTGAGATGATCTTATTTCAGTACG ATGTGAAGATGAAGGAGAAGGGACATCCCTGAGGGCTATTCTGTGAGCA GGGAGACATCTATGTCAGCCGTTCAGCTGATCCTGAGTCCGCCTCTACCACC AGACCTTTTGGCCAGGGCACCAGGCTGACACAGTGGTGGAGGACCTGAATAA GGTGTTCCCCCCTGAGGGTGGCCGTGTTTGAGCCATCCGAGGCCGAGATCTCT CACACCCAGAAGGCCACCCTGGTGTGCCTGGCAACCGGCTTCTTTCCCGATC ACGTGGAGCTGTCTTGGTGGGTGAACGGCAAGGAGGTGCACTCTGGCGTGTG CACAGAGCCCCTGAAGGAGCAGCCTGCCCTGAATGATAGCCGCTAT TGTCTGTCTAGCAGGCTGCGCGTGTCCGCCACCTTTTGGCAGAATCCCAAGA ATCACTTCCGCTGCCAGGTGCAGTTTTACGGCCTGTCCGAGAATGACGAGTG GACCCAGGATAGGGCCAAGCCAGTGACACAGATCGTCTGCCAGGGCATG GCCCAGAGACTGTGGTCCTTCACCAGGTGCTTCCACCAGCCGTGCTG AGCGCCACCATCCTTATGATGATCTGCTGGGCAGCCACACTGTCTACGCCG TGCTGGTGTCCGCCCTGGTCTGATGGCCATGTGAAGCGAAGGACTTC | TCR 14 - Beta Codon-optimized/ cysteine-modified Homo sapiens (nt) |
| 8 | ATGGGAACCAGGCTGCTGTGCTGGGTCGTGCTGGGCTTTCTGGGAACCGACC ACACAGGAGCAGGGGTGTCCAGTCCAGTCTCCAAGGTACAAGGTGGCCAAGAGAG GCCAGGGATGTGGCCCTGAGATGTGACCCCCATCTCCGGCCACGTGTCTCTGTT CTGGTACCAGCAGCCCTGGGACCAGGGACCAGAGTTCTCTGACACATATTTTCAG AACGGCCACAGCCAGTGCGATAAGAGCGGCCTGCCTTCCGACAGGTTCTTTGCAG AGCGCCCAGACTCCCGCTGTCCACCCTGAAGATCCAGAGACACAGCAGG AGGACTCCGCCGTGTACCTGTGCGCCAAGCTCCTGACCGTGCTGGAGGATCTGAAGAA CGTGTTTCCCCCTGGAGGTGGCCGTGTCCAGCCTAGCGAGGCCGAGATCTCC CACACCCAGAAGGCCACCCTGGTGTGCCTGGCAACCGGCTTCTATCCAGACC ACGTGGAGCTGAGCTGGTGGGTGAACGGAGACAGCCCGCCCTGAATGATAGCCGCT ACTGTCTGTCTAGCCGGCTGCGAGAGTGTCCGCCACCTTTTGGCAGAACCCTAG GAATCACTTCCGCTGCCAGGTGCAGTTTTATGGCCTGTCCGAGAACGACGAG TGGACCCAGGAGCGCGATTGTGGCCTAAGCCTGACACAGATCGTGTGCCAGGCAT GGGGCAGAGCCCGATTGTGCCTCTACATCTGAGAGCTGTGGGCAAGGCCACTGTGCT GTCGCCCAGGCCACCATCCTGTACGAGATCCTGCTGGGCAAGGCCACACTGTATGCC GTGCTGGTGAGCGCCCTGGTGCTGATGGCCATGGTGAAGAGAAGGACTCTA GAGGA | TCR 13 - Beta Codon-optimized/ cysteine-modified Homo sapiens (nt) |

| SEQ ID NO. | SEQUENCE | DESCRIPTION |
|---|---|---|
| 9 | ATGGACACCTGGCTCGTGTGCTGGGCCATCTTCAGCCTGCTGAAGGCAGCC TGACCAGCCTGAGGTGACCCAGACACCATCCCACCAGGTGACACAGATG GCCAGGAAGTGATCTGCGTGCGTGCCTATCTCCAACCACCTGTACTTTTAT TGGTACAGACAGATCAGCGAGAAGTCCGAGATCTTTGACGATCAGTTCTACTACA ACAATGAGATCAGCGAGAAGTCCAACTTCCTGAAGATCCTGCCAAAGCTGAA GAGGCCGACGCAGCAACTTCTGCAGATCTTTGCGCCACACGGAGCTCCTACGAGCAG GATTCTGCCATGTATTTCTGCGCCACCAGATGACCGTGACCGACTGAGATCAGCCACAC TCCCCCCTGAGGTGCCGTGTTCGACCATCTGAGGCCCATGCTGGCCCATCTGGAGAT GGGCGCCCATCGAGTGCCCGAGATGGCTTCTACCCGATCACGTG CCAGAGGCCACCCTGGTGTGCCTGGCAACGGCTTCTACCCGATCACGTG GAGCTGAGCTGGTGGGTGAACGGCAAGGAGGTGCACTCCGGTGTGCACA GACCCACAGCCCCTGAAGAGCAGCCGCCTGAATGATAGCAGATACTGTC TGTCTAGCCGGCTGAGAGTGTCCGCCACCTTCTGGCAAGACACCGGAATCA CTTTGCGCTGCAGGTGCAGTTCTATGGCCTGTCTGAGAACGACGAGTGGACC CAGGATAGGGCCAAGCCAGTGACACAGATCTGAGCGCCCAGGCATGGGGC AGAGCCGATTGTGGCTTTACAAGGAGTCCTATCGACAGGGCGTGCTGTCCG CCACCATCCTGTACGAGATCCTGGGCAAGGCCACACTGTATGCCGTGCT GGTGTCTGCCCTGGTGCTGATGGCCATGGTGAAGAGGAAGGACTCCAGAGG A | TCR 12 - Beta Codon-optimized/ cysteine-modified Homo sapiens (nt) |
| 10 | ATGGAGAAGAATCCTCTGGCCGCCCCACTGCTCTGTGGTTCCACTGG ACTGCGTGTCCTATCCGAGATGGAGCAGCAGCCCAGTCCTCCACGT GCAGGAGGGCGATAGCACCCAACTTCCTGCCCTCCCAACTTCT ACGCCCTGCACTGGTACCGGTGGAGACAGCCCAAGAGCCCAGAGGCCTGT TCGTGATGACACTGAACGGCGAGGAGGGCTACTCCTATCTGTACATCAAGGGCAGCCAGCC CCCTGAATACAAAAGGAGGGCTACTCCTATCTGTACATCAAGGGCAGCCAGCC CGAGGATTCCGCCACCTACCTGTGCGCCTCCAGACAGGCGCCAACAATCTG TTCTTTGGACCGGCACAAGGCTGACCGTGACCGTGAATCCCTTATATCCAGAACCCAG ACCCTGCCGTGTACCAGCTGAGGGACTCTAAGTCTAGCGATAAGAGCGTGTG CCTGTTCACCGACTTTGATTCTCAGACAAACGTGACCCAGAGCAAGGACAGC GACGTGATCCACCGACAAGTGCCTGCTGTGGATATAGAAGCATGGACTTTA AGTCCAACTCTGCCCTGGCCTGGTCTAATAAGAGCGATTTCGCCTGCGCCAA CGCCTTTAACAATTGCCATATCCCCGAGATACATTCTTCCATCTCCGAGT CCTCTTTGTGACGTGAAGCTGGTGTGAGAAGAGCCTTTCGAGACAGATACAAACCT GAATTTTCAGAACCTGAGCGTGATCGGCTTCCGGATCCTGCTGCTGAAGGTG GCCGGCTTCAATCTGCTGATGACCCTGAGACTGTGGAGCTCCTGA | TCR 14 - Alpha Codon-optimized/ cysteine-modified Homo sapiens (nt) |
| 11 | ATGCTGCTGCTGCTGGTGCCAGTGCTGGAAGTGATCTTCACCCTGGGAGGAA CAAGGGCACAGTCTGTGACCCAGCTGGACAGCCACGTGTCCGTGTCTGAGGG CACACCCGTGCTGCTGAGATGCAACTACTCCTCTAGCTATCGCCCCCTGT TTGGTACGTGCAGCACCCTAATAAGGGCCTGCAGCTGCTGCTGAAGTATAC CCCGCCGCCAGCACACTGGTGAAGGGCATCAATGGCTTCGAGGCCGAGTTTAAG AAGAGCGAGACCAGCTTCCACCTGACCAAGCCTTCCGCCCACATGTCTGACG CCGCCGAGTACTTTTGCGTGGTGCGGGAGGCAAGCATCCAGAATCCGATCTTCGGACAGG AACCGAGCTGAGCGTGAAGCCAAACATCCAGAATCCCGATCCTGCCGTGTAT CTGATTCTCAGAACCTCAGGAGCAAGGACAGCAGCAGCGTGTACATCAC CGACAAGTGCGTCTGGATATGCGGAGCAGGACAGCGACATGATCCAACTTAAGTGACTTTAAGTCCAACTCTGCC | TCR 13 - Alpha Codon-optimized/ cysteine-modified Homo sapiens (nt) |

SEQUENCE TABLE-continued

| SEQ ID NO. | SEQUENCE | DESCRIPTION |
|---|---|---|
| | GTGGCCTGGTCTAATAAGACGATTTCGCCTGCCGCCAATGCCTTTAACAATT CCATCATCCCGAGAGATACATTCTTTCCATCTCCCGAGAGCTCCTGTGACGTG AAGCTGTGGAGAAGAGCTTCGAGACAGATACAAACCTGAATTTCAGAAC CTGAGCGTGATCGGCTTCAGGATCCTGCTGAAGGTGGCCGGCTTCAATC TGCTGATGACCCTGCGCCTGGTCTAGCTGA | |
| 12 | ATGAGAGACATTTGCCGGTCTCTCTTTTCTTCCTGTGGCTGCAGCTGATTG CATGAGCAGGGGCGGAGGACTGGAGCAGGAGCCTGTTCCTGTCCGTGCCGA GGGCGATTCCTCTGTGATCAACTGTACCTACACAGACAGCTCCTACTATC TGTACTGGTATAAGCAGGAGCCAGGAGCAGGCCTGCAGCTGCTGACCTATAT CTTTTCCAACAGACATGGAGCAGGATCAGCGGCTGACAGTGCTGCTGAAT AAGAAGGACAAGCACCTGAGCCTGAGAATCGCTGACACCCAGACAGGCGAT TCCGCCATCTACTTCTGCGCCTGCCATGGCGCCACCAATAAGCTGATCTT TGGAACCGGCACACTGCTGCAGCGGCAGTGCAGCCTAAACATCCAGAATCCCGATCCT GCCGTGTACCAGCTGCGGGACAGCAGGAGCTCCGATAAGTCCGTGTGCCTGT TTACCGACTTCGATTCTCAGACAAACGTGTCTCAGAGCAAGGACAGCGACGT GTACATCACCGACAAGTGCGTGCTGGATATGAAGAGCGACTTTGCCTGCGCCAATGCT AACTCTGCCGGTGGCCTGGTCTAATAAGACGATTTGCCTGCCAATGTCTAGC TCAACAATTCCATCATCCCGAGAGATACATTCTTTCCATCTCCCGAGTCTAGC TGTGACGTGAAGCTGTGGAGAAGAGCTTCGAGACAGATACAAACCTGAAT TTCAGAACCTGTCTGATGATCGGCTTTAGGATCCTGCTGAAGGTGGCCG GCTTTAATCTGCTGATGACCCTGCGCCTGGTCCTCTTGA | TCR 12 - Alpha Codon-optimized/ cysteine-modified Homo sapiens (nt) |
| 13 | ATGGGCATCCGGCTGCTGCTGTCAGAGTGGCCTTCTGTTTTCTGGGCCTT GGTGGACGTGAAGTGACCCAGAGCTGACCCAGAGCTCCCGTATCTGGTGAAGAGAACAGG CGAGAAGGTGTTTCTGAGGGTGCTGTCAGGACATGGATCACGAGAACATGTTC TGGTACAGCCAGGATCCAGGCCTGGGCCTGAGACTGATCTATTCAGCTACG ATGTGAAGATGAAGGAGGACACATCCCTGAGCGCTATTCTGTGAGCA GGGAGAAGAAGGAGCGGTTCAGCCTGACCATCCTGGAGTCCGCCCTCTACCAACC AGACATCTATGTACCTGTGCGCAAGGCTGACAGTGGTGCAGGACCTGAATAA GGTGTTCCCCCCTGAGGTGCCGTGTTTGAGCCATCCGAGGCCGAGATCTCT CACACCCAGAAGGCCACCCTGGTGTGCCTGGCCAACGGCTTCTTTCCCGATC ACGTGGAGCTGTCTTGGTGGGTGAACGGCAAGGAGTGCACTCTGGCGTGTG CACAGACCCAGGACCCTCGCAGCCCCGTCAGCCCACCTTTTGGCAGAACCCAAGGA TGTCTGTTAGCAGGCTGGCCGTGTCCGCACCCTTTGGCAGAACCAAGGA ATCACTTCCGCTGCCAGGTGCAGTTTTTACCGCCTGTCACAGATCGTGTCTGCCGAGGATG GACCCAGATAGGGCCAAGCCAGTGACACAGCAGTCGTGTCTGCCAGGCATG GGGCAGAGCACTGTGGCTTCACCAGCTGTCCTACAGCCAGGGCCGTGCTG AGCGCCACATCCTGTATGAGATCCTGTGGGGCAAGCCACACTGTACGCCG TGCTGGTGTCCCCTGGTCTGCGATGGCCATGGTGAAGCGGAAGGACTTCGG CTCCGGCGCCACAAACTTTCTCTGCTGAAGCAGGCAGGCGATGTGGAGGAG AACCCTGGACCAATGGAGAAGAATCCTCTGGCCGCCCTGCTGAATCCTGT GGTTCCACTGGACTGGCGTGCTCCTCTATCCGAATGTGGAGCAGAGCCCACA GTCCCTGCACGTGCAGGAGGCGATAGCACCACCACTTCACATGTTCCTCT AGCTCCAACTTCTACGCCCTGCACTGGTACCGGTGGGAGCAGCCAAGAGCC CAGAGGCCCTGTTCGTGATGACACTGAACAAGGAGCTACTCCTATCTGTACATCAA GAATCAGCGCCCTGATACAAAGGAGGGCTACTACCTGCGCCAAGAGGGCA GGGCAGCAGCCCTGATGAATAAGGAGCTACTCCTATCTGTACATCAA GGGCAGCAGCCCAGCAGCAGCTTCCGCCATCCTGTGCCTCCCAGACAGGC | TCR 14 Codon-optimized/ cysteine-modified full sequence Homo sapiens (nt) |

| SEQ ID NO. | SEQUENCE | DESCRIPTION |
|---|---|---|
|  | GCCAACAATCTGTTCTTTGCACCGGCACAAGGCTGACCGTGATCCCTATA TCCAGAACCCAGACCCTGCCGTGTACCAGCTGAGGGACTTCTAAGTCTAGCGA TAAGAGCGTGTGCCTGTTCACCGACTTTGATTCTCAGACAACGTGAGCCAG AGCAAGGACAGCGACGTGTACATCACCGACAAGTGCTGCTGAGATATGAGA AGCATGGACTTTAAGTCCAACTCTGCCGTGCCTGTCTAATAAGAGCGATT TCGCCTGCGCCAAGCCTTTAACAATTCCATCATCCCCGAGGATACATTCTTT CCATCTCCGCCTCCTTTGTAGGAGAAGCGTGGAGAGAGCTTCGAGA CAGATACAAACCTGAATTTTCAGAACCTGCTGATCGGCTTCCGATCCT GCTGCTGAAGGTGGCCGGCTTCAATCTGCTGATGACCCTGAGACTGTGAGC TCCTGA | |
| 14 | ATGGGAACCAGGCTGCTGTGGGTGGTGCTGGGCTTCTGGGAACCGACC ACACAGGAGCAGGGCTGTCCCAGTCTCCAAGGTACCAAGGTGGCCAAGAGAG GCCAGGATGTGGCCCTGAGATGTGACCCCATCTCCGGCCACGTGTCTCTGTT CTGGTACCAGCAGGCCCTGGGACCAGAGTTCCTGACATATTTTCAG AACGAGGCCCAGCTGGATAAGAGCGGCCTGCCTTCCGACAGGTTCTTTGCAG AGCGCCCAGAGGGAAGCGTGTCCACCCTGAAGATCCAGAGGACACAGCAGG AGGACTCCGCCGTGTACCTGTGCGCCAGCCTGCGTGCTGAGGATCTGAAGAA AGTCTTTTTGGAGAGGAGGCAGCCCGTCTGACCGTGCTGGAGGATCTGAAGAA CGTGTTCCCCGAGAAGGCACCCTGGTGCTGTGCCAAGAGCCGAGATCTCC CACACCCAGAAGGCCACCCTGGTGTGCCTGGCAACCGGCTTCTATCCGGCAC ACGTGGAGCTGAGTGGAAGGACCAGCCCCTGAATGATAAGCCGCT GCACAGCCCACAGCCCTGAAGGACCAGCCCCGTGAAGAGCAACAACCGCCTGT ACTGTCTGTCGGCCTGAGAGTGTCCAGTGCAGTTTATGCCTGCCGAGAACGACGAG GAATCACTTCCGGCTGCCAGGATCGGGCCAAGCCCTGAACTGTGTCGCCGAGGGCAT TGGACCCAGGATGGGCTTCACCATCTGAGACTGAGAGCTACCAGGGCGTGCT GGGCCAGGATCGGCCAAGCCCTGAACTGTGTCGCCGAGGGCATGCT GTCCGCCACCATCCGTCATCTGCTGATGAGGGCCATGGAGAAGGAGGACTCTA GTGCTGGTGAGCCGCCTGGTGCTGATGCATCCTCTGTGGGACAGGCAGGCCGGCATG TGGAGAGAGAATCCTGGGCCAATGCTGCTCTGCTGTGCCAGTGCTGGAAGT GATCTTCACCCTGGGAGAACCAGGCACAGTCTGTGACCAGCTGGACAG CCAACGTGTCCGTGTCAGGGGCACACCTGTCTGAGATGCAACTACTCC TCTAGCTATAGCCCCTCCCTGTTTGGTACGTCAGCACCCTAATAAGGGCCT GCAGCTGCTGAAGTATACCTCCCGCCACACTGGTCAAGCGGCATCAAT GGCTTCACGCCGAGTTAAGAAGACGAAGGACAAGCTTCACCTGACAAAG CCTTTCCGCCACATGTCTGCAGCCCGGGGACTACATTTTCGCCTGTCGGGAG GCAAGCTGATCTTCGACAGGAACCGAGCTGAGCCGTGAAGCCAAACATCC AGAATCCCGACCTCTGCCGTGTATCAGCTGCGCGACTCCAAGTCTCTGATAA GAGCGTGCTGGACTCTGTTCACCGACTTGATTCTCAGACAACGTGTCTCAGAGC AAGGACAGCGACGTGTACATCACCGACAAGTGCGTGCTGATATGCGAGC ATGGACTTTAAGTCCAATGCCTTTAACAATTCCATCATCCCGAGGATACATTCTTTCCA TCTCCGAGAGCTCCTGTGTCACCGACTTTGATTCTCAGACAACGTGCTCAGAGAC ATACAAAACCTGAATTTTCAGAACCTGCTGATCGGCGTGATCGGCTTCAGGATCCTGCT GCTGAAGGTGGCCGGCTTCAATCTGCTGATGACCCTGCGCCTGTGGTCTAGC TGA | TCR 13 Codon-optimized/ cysteine-modified full sequence Homo sapiens (nt) |

| SEQ ID NO. | SEQUENCE | DESCRIPTION |
|---|---|---|
| 15 | ATGGACACCTGGCTCGTGTGTGCTGGGCCATCTTCAGCCTGCTGAAGGCAGCC<br>TGACCGAGCCTGAGGTGACCCAGAGACACCATCCCACCAGGTGACACAGATG<br>GCCAGGAAGTGATCCTGCGGTGCGTGCCTATCTCCAACCACCTGTACTTTTAT<br>TGGTACAGACAGATCCTGGGCCAGAAGGTGGAGTTTCTGTGAGCTTCTACA<br>ACAATGAGATCAGCGAGAAGTCCGAGATCTTTGACGATCAGTTCTCTGTGGA<br>GAGGCCGACGCCAGCAACTTCACCCTGAAGATCCGCTCCACAAAGCTGAA<br>GGATTCTGCCATGTATTTCTGCGCCACCAGCAGCGACCCCAGCGAGAAGGGGA<br>TATTTTGGCCCTGAGGTGCCGTGTTGCAGCCATCTGAGGCCCATCAGCCACAC<br>TCCCCCCTGAGGTGCCGTGTTGTCCGCCCGCTTCTACCCGATCACGTG<br>CCAGAGATCACCCTGGTGTGCCTGGCAACGGCTTCTACCGATCACGTG<br>GAGCTGAGCTGGTGGTAACGGCAAGGAGGTGCACTCCCCGCGTGCCACCATG<br>GACCCACAGCTCGTGAAGGAGCAGCTGCCCTGAATGATAGCAGATACTGTC<br>TGTCTAGCCGGCTGAGAGTGTCCGCCACCTTCTGGCAGAACCCAAGGAATC A<br>CTTTCGTGCCAGGTGCAGTTCTATGCCTGTCTGAGAACGACGAGTGGACC<br>CAGGATAGGGCCAAGCCAGTGACACAGATCTGAGCGCCCAGGCATGGGGC<br>AGAGCCGATTGTGGCTTTACAAGCGAGTCCTATCAGGGCGTGCTGCCTGCT<br>CCACCATCCTGTACAGAGATCCTGGGCAAGGCCACACTGTATGCCGTGCT<br>GGTGTCTCCCTGGTGCTGATGCCATGGTGAAGGAAGGAAGACTCCAGAGG<br>AGGATCTGGAGCCACCACACTTCTCCCTGCTGAAGCTGAGCCGATGTGGAG<br>GAGAATCTCGCCCCAATGAAGACATTCGCGGCTTCTCTTTTCTTGTTCCTGTG<br>GCTGCAGCTGGATTGCATAGCAGGGCCAGGAGCTGGAGCAGAGCCCTGTT<br>CCTGTCCGTCGGAGGGCGATTCCTGCTGTGATCAACTGTACCTACAGAC<br>AGTCCTCTACTATCTGTATCTGGTATAAGCAGGAGCAGGAGCAGGCCTGC<br>AGTCGTGACCATCTATAATCTTTTCCAACATGACAACATGAAAGCAAGCGGCT<br>GACAGTGCTGCTGAATAAGGAAGGACAAGCACTACTTCTGCGCCTGTCTGGGCGCC<br>CACCCAGAGATGATTTTCCGCCATCTACTTTCTGCCCCGTGCCCTCGGGCCC<br>ACCAATAAGCTGATCTTTGGAACCGGCACACTGCTGGCAGTGCAGCCTAACA<br>TCCAGAATCCGTGTGCCTGTTTACCGACTTCGATTCTCAGACAAAAGCTGTCTCAGA<br>TAAGTCCGTGTGCCTGTTTACCGACTTCGATTCTCAGACAAACGTGCTCAGA<br>GCAAGGACAGCGACGTGACATCACCGACAAGTGCGTGCTAATAAGACGACTT<br>GCATGAGTTCAAGTCAACTTCGCCCTGCCTGTCTGATAAGAGCGACTT<br>TGCCTGCGCCAATGCCTTCAGCTGTGACGTGAACCTGTCTGATGCGGTTCGAGAC<br>CATCTCCGAGTCTAGCTGTGACGTGAACCTGTCTGATCGGCTTAGGATCCTG<br>AGATACAAACCTGAATTTCCAGACTTCGCCCCTGAGAGAGAGCTTTAGGATCCTG<br>CTGCTGAAGGTGGCCGGCTTTAATCTGTCTGATGACCCCTGCCCTGTCCTC<br>TTGA | TCR 12<br>Codon-optimized/<br>cysteine-modified full<br>sequence<br>Homo sapiens<br>(nt) |
| 16 | ATGGGAATCAGGCTCCTCTGCTGTGTGGCCTTTTGTTCCTGGCTGTGTAGGCCT<br>CGTAGATGTGAAAGTAACCCAGAGCTGCGAGATATCTAGTCAAAAGGACGGG<br>AGAGAAGTTTTTCGAAGTGTCTCAGGATATGACCATGAAAATATGTTC<br>TGGTATCGACAAGACCCAGTCTGGGCTACGGCTGATCTATTTCTCATATG<br>ATGTTAAAATGAAGGAAAAGGAGATATTCCTGAGGGGTACAGTGTCTCTA<br>GAGAGAAGAGCCTTCTCCTGAGTCCCCAGCACCAACCA<br>GACATCTATTTACCTCTGTGCCAGCACCTTCTGGGACAGCAGGACTGAA<br>GCTTTCTTTGGACAAGGCACCAGACTCACAGTTTGAGCCATCAGAAGCAGAGAACCTGAAGG<br>TGTTCCCACCCGAGGTGCTGTGTTTGAGCATCAGAAGCAGAGAGTCTCCA<br>CACCCAAAAGGCCCACTGTGTTCTGGGCCACAGGCTTCTTCCCTGACCAC<br>GTGGAGCTGAGCTGGTGGGTGAATGGGAAGGAGGTGCACAGTGGGGTCAGC | TCR 14 - Beta<br>Native<br>Homo sapiens<br>(nt) |

SEQUENCE TABLE-continued

| SEQ ID NO. | SEQUENCE | DESCRIPTION |
|---|---|---|
| | ACGGACCCCGCAGCCCTCAAGGAGGAGCCCGCCTCAATGACTCAGATACT GCCTGAGCAGCCGCCTGAGGGTCTCGGCCACCTTCTGGCAGAACCCCGCAA CCACTTCCGCTGTCAGTCCAGTTCAGGGCTCTTACGGCTCTGGAGAATGACGAGTGG ACCCAGGATAGGGCCAAACCGTCACCCAGATCGTCAGCGCCGAGGCCTGG GGTAGAGCAGACTGTGGCTTTACCTCGGTGTCCTCCAGCAGGCAAGGGGTCCTGT CTGCCACCATCCTCTATGAGATCCTGCTAGGGAAGGCCACCCTGTATGCTGT GCTGGTCAGCGCCCTTGTTGATGCCATGGTCAAGAGAAAGGATTTCTGA | TCR 13 - Beta Native Homo sapiens (nt) |
| 17 | ATGGGCACCAGGCTCCTCTGCTGGGTGGTCCTGGGTTTCCTAGGGACAGATC ACACAGGTGCTGGAGTCTCCCAGTCCCTAGGTACAAAGTCGCAAGAGAG GACAGGATGTAGCTCTCAGGTGTCATTTGGGTGCATGTATCCCTTTTT TGGTACCAACAGGCCCTGGGGCAGGGGCCAGAGTTTCTGACTTATTCCAGA ATGAAGCTCAACTAGACAAATCGGGGCTGCCAGTGATGCTTCTTTTGCAGA AAGCCTGAGGGATCCGTCTCCACTCTGAAGATCCAGCGCACACAGCAGGA GGACTCCGCCGTATCTCTGTGCCACAGCCCGACAGGGACTGAGAGGGA GCTGTTTTTTGGAGAGGCTCGTGTTGAGCCATCAGAAGCAGAGATCTCCC GTGTTCCCACCCGAGGTCGCTGTTGAGCCATCAGAAGCAGAGATCTCCC ACACCCAAAGGCCACACTGGTGTGCCTGGCCACAGGCTTCTACCCCGACCA CGTGGAGCTGAGCTGGTGGTGAATGGAAGGAGGAAGTGCACAGTGGGTCAG CACAGACCCCAGCCCCTCAAGGAGGCAGCGCCCTCAATGACTCAGATAC TGCCTGAGCAGCCGCCTGAGGGTCTCGGCCACCTTCTGGCAGAACCCCGCCA ACCACTTCCGCTGTCAGTCCAGTTCTACGGGCTCTGGAGAATGACGAGTG GACCCAGGATAGGGCCAAACCGTCTCACCCAGATCGTCAGCGCCGAGGCCTG GGTAGAGCAGACAGTGGCTTTACCTCAGTGTTCCAGCAGGCAACCTTGTATGCCGT TCTGCCACCATCCTCTATGAGATCTTGCTAGGGAAGGCCACCTTGTATGCCGT GCTGGTCAGTGCCCTCGTGCTGATGGCCATGGTCAAGAGAAAGGATTCCAGA GGCTAG | |
| 18 | AQKITQTQPGMFVQEKEAVTLDCTYDTSDQSYGLFWYKQPSSGEMIFLIYQGSY DEQNATEGRYSLNFQKARKSANLVISASQLGDSAMYFCAMREGRGFKTIPGAGT RLFVKANIQKPDPAVYQLRDSKSSDKSVCLFTDFDSQTNVSQSKDSDVYITDKT VLDMRSMDFKSNSAVAWSNKSDFACANAFNNSIIPADTFFPSPESSCDVKLVEKS FETDTNLNFQNLSVIGFRILLLKVAGFNLLMTLRLWSS | TCR 3 - Alpha Native Homo sapiens (aa) |
| 19 | AQKITQTQPGMFVQEKEAVTLDCTYDTSDQSYGLFWYKQPSSGEMIFLIYQGSY DEQNATEGRYSLNFQKARKSANLVISASQLGDSAMYFCAMREGRGFKTIPGAGT RLFVKANIQKPDPAVYQLRDSKSSDKSVCLFTDFDSQTNVSQSKDSDVYITDKC VLDMRSMDFKSNSAVAWSNKSDFACANAFNNSIIPADTFFPSPESSCDVKLVEKS FETDTNLNFQNLSVIGFRILLLKVAGFNLLMTLRLWSS | TCR 3 - Alpha Cysteine-modified Homo sapiens (aa) |
| 20 | ATGTCACTTTCTAGCCTGCTGAAGGTGGTCACAGCTTCACTGTGGCTAGGAC CTGGCATTGCCCAGAAGATAACTCAAACCCAACCAGGAATGTTCGTGCAGGA AAAGGAGGCTGTGACTCTGGACTGCACATATGACACCAGTGATCAAAGTTAT GGTCTCTTCTGGTACAAGCAGCCCAGCAGTGGGGAAATGATTTTTCTTATTTA TCAGGGGTCTTATGACGAGCAAAATGCAACAGAAGGTCGTAGCTTAAATTGAAT TTCCAGAAGGCAAAATCCGCAACCTTGTCATCTCCGCTTCACAACTGG GGGATTCAGCAATGTATTTCTGCAATGAGAGAGGGGCGAGGCTTCAAA CTATCCTTTGGAGCTGAACAAGACTATTTGTTAAAGCAAATATCCAGAAGCC TGACCCTGCCGTACCAGCTGAGAGACTCTAAATCCAGTGACTCTGTC | TCR 3 - Alpha Native Homo sapiens (nt) |

SEQUENCE TABLE-continued

| SEQ ID NO. | SEQUENCE | DESCRIPTION |
|---|---|---|
| | TGCCTATTCACCGATTTTGATTCTCAAACAAATGTGTCACAAAGTAAGGATTC TGATGTGTATATCACAGACAAATCAGACAAACTGCTAGACATGAGTCTATGGACTTC AAGAGCAACAGTGCTGTGGCTGGAGCAACAAATCTGACTTTGCATGTGCAA ACGCCTTCAACAAGACCATTATTCCAGCAGACACCTTCTTCCCAGCCTGA AAGTTCCTGTGATGTCAAGCTGGTCGAAGAAAGCTTTGAAACAGATACGAAC CTAAACTTTCAAAACCTGTCAGTGATTGGGTTCCGAATCCTCCTGAAAGT GGCCCGGGTTTAATCTGCTCATGACGGCTGCGCTG | |
| 21 | ATGTCACTTTCTAGCCTGCTGAAGGTGGTCACAGCTTCACTGTGCTAGGAC CTGGCATTGCCCAGAAGATAACTCAAACCCAACCAGGAATGTTCGTGCAGGA AAAGGAGGCTGTGACTCTGAACTGCACATATGACACCAGTGATCAAAGTTAT GGTCTCTTCTGGTACAAGCAGCCCAGCAGTGGGGAAATGATTTTCTTATTA TCAGGGGTCTTATGACGAGCAAATGCAACAGAGAGGTCGCTACTCATTGAAT TTCCAGAAGGCAAGAAAATCCGCCAACCTTGTCATCTCCCCTTCACAACTGG GGGACTCAGCAAATGTATTTCTGTGCAATGAGAGAGGGGCGAGGCTTCAAAA CTATCTTTGGAGCAGGACAGGAAACAGACTATTTGTTAAAGCAAATATCAGAAGCC TGACCCTGCCGTGTACCAGCTGAGAGACTCTAAATCCAGTGACAAGTCTGTC TGCCTATTCACCGATTTTGATTCTCAAACAAATGTGTCACAAAGTAAGGATTC TGATGTATATCACAGACAAATGTGCTAGACACAAGTGACACCAGTCTATGGACTTC AAGAGCAACAGTGCTGTGGCTGGAGCAACAAATCTGACTTTGCATGTGCAA ACGCCTTCAACAAGACCATTATTCCAGCAGACACCTTCTTCCCAGCCAGA AAGTTCCTGTGATGTCAAGCTGGTCGAAGAAAGCTTTGAAACAGATACGAAC CTAAACTTTCAAAACCTGTCAGTGATTGGGTTCCGAATCCTCCTGAAAGT GGCCCGGGTTTAATCTGCTCATGACGCTGCGGCTG | TCR 3 - Alpha Codon-optimized/cysteine-modified Homo sapiens (nt) |
| 22 | GAGVSQSPRYKVAKRGQDVALRCDPISGHVSLFWYQQALGQGPEFLTYFQNEA QLDKSGLPSDRFFAERPEGSVSTLKIQRTQQEDSAVYLCASSHLAGFTGELFFGE GSRLTVLEDLKNVFPPEVAVFEPSEAEISHTQKATLVCLATGFYPDHVELSWWV NGKEVHSGVCTDPQPLKEQPALNDSRYCLSSRLRVSATFWQNPRNHFRCQVFY GLSENDEWTQDRAKPVTQIVSAEAWGRADCGFTSESYQQGVLSATILYEILLGK ATLYAVLVSALVLMAMVKRKDSRG | TCR 3 - Beta Native Homo sapiens (aa) |
| 23 | GAGVSQSPRYKVAKRGQDVALRCDPISGHVSLFWYQQALGQGPEFLTYFQNEA QLDKSGLPSDRFFAERPEGSVSTLKIQRTQQEDSAVYLCASSHLAGFTGELFFGE GSRLTVLEDLKNVFPPEVAVFEPSEAEISHTQKATLVCLATGFYPDHVELSWWV NGKEVHSGVCTDPQPLKEQPALNDSRYCLSSRLRVSATFWQNPRNHFRCQVQF YGLSENDEWTQDRAKPVTQIVSAEAWGRADCGFTSESYQQGVLSATILYEILLG KATLYAVLVSALVLMAMVKRKDSRG | TCR 3 - Beta Cysteine-modified Homo sapiens (aa) |
| 24 | ATGGGCACCAGGCTCCTCTGCTGGGTGGTCCTAGGCTTCCTAGGGACAGATC ACACAGGTGCTGGAGCTCTCCAGTGCTCCCCTAGGTACAAAGTCGCAAGAGAG GACAGGATGTAGCTCTGACTGTGATCCAATTTCGGGTCATGTATCCCTTTTT TGGTACCAACAGGCCCTGGGGCAGGGGCCAGAGTTTCTGACTTATTCCAGA ATGAAGCTCAACTAGACAAATCGGGGCTGCCCAGTGATCGCTCTTTTGCAGA AAGGCCTGAGGATCCGTCTCCACTCTGCCAGCAGATCAGCGACACAGGA GGACTCCGCCGTGTATCTCTGTGCCAGCAGCCACCTCGCCGGTTCACCGGG ACGTGTTTTGGAGAAGGCTCTAGGCTGTTTGAGCCATCAGAAGCAGAGATCTC AAGGCTCTCCACCCGAGGTCACTCGTGTGCTGGCCCTGGCACAGGCTTCTACCCGAC | TCR 3 - Beta Native Homo sapiens (nt) |

| SEQ ID NO. | SEQUENCE | DESCRIPTION |
|---|---|---|
|  | CACGTGGAGCTGAGCTGGTGGTGAATGGGAAGGAGGTGCACAGTGGGGTC<br>AGCACAGACCCGTGAGTCCCCTCAAGGAGCAGCCCCCTCAATGACTCCAGAT<br>ACTGCCTGAGCAGCCGCCTCAAGTCCGGCTCCACCTTCTGGCAGAACCCCG<br>CAACCACTTCCGTGCAAGTCCAGTTCTACGGCTCTCGGAGAATGACGAG<br>TGGACCCAGATAGGGCCAAACCTGTCACCCAGATCGTCAGCGCCGAGGCT<br>GGGGTAGAGCAGAGCTGTGGCTTCACCCTGAGTCCTTACCAGGAGGGTCCT<br>GTCTGCCACCATCCTCTATGAGATCTTGCTAGGGAAGGCCACCTTGTATCC<br>GTGCTGGTCAGTGCCCTCGTGCTGATGGCCATGGTCAAGAGAAAGGATTCCA<br>GAGGC |  |
| 25 | ATGGGCACCAGGCTCCTCTGCTGGGTTGTCCTGGGTTTCCTAGGACAGATC<br>ACACAGGTGCTGGAGTCTCCAGGTGTCCCCTAGGTACAAAGTCGCAAGAGAG<br>GACAGGATAGCTCTCCAGGTGTCATCCAATTTCGGTCATGTATCCCTTTTT<br>TGGTACCAACAGGCCCTGGGGCAGGGCCAGAGTTTCGACTTATTTCCAGA<br>ATGAAGCTCAACTAGACAAATCGGGGCTGCCAGTGATGCTGCTCTTGCAGA<br>AAGGCCTGAGGGATCCGTCTCCACTCTGAAGATCAGCGCACACAGGA<br>GGACTGCGCGTGTATCTGTGCCAGCAGCCACCTCGCCGGGTTCACCGGG<br>GTGTTTTTGGAGAAGGCTCTAGGCTGACCGTACTGGAGGACCTGAAAA<br>ACGTGTTCCACCCGAGGTCGTTGTTTGAGCCATCAGAAGCAGAGATCTC<br>CCACACCCAAAAGGCCACACTGGTGTGCCTGGCCACAGGCTTCTACCCCGAC<br>CACGTGGAGCTGAGCTGGTGGGTGAATGGGAAGGAGGTGCACAGTGGGGTC<br>TGTACAGACCCGTCAGCCCTCAAGGAGCAGCCCGCTCAATGACTCCAGAT<br>ACTGCCTGAGCAGCCGCCTCCGTCAAGTCCAGTTCTACGGGCTCTGCAGAACCCCCG<br>CAACCACTTCCGTCTCAAGTCCAGTTCTACGGGCTCTCGGAGAATGACGAG<br>TGGACCCAGATAGGGCCAAACCTGTCACCCAGATCGTCAGCGCCGAGGCT<br>GGGGTAGAGCAGAGCTGTGGCTTCACCCTGAGTCCTTACCAGGAGGGTCCT<br>GTCTGCCACCATCCTCTATGAGATCTTGCTAGGGAAGGCCACCTTGTATGC<br>CGTGCTGGTCAGTGCCCTCGTGCTGATGGCCATGGTCAAGAGAAAGGATTCCA<br>GAGGC | TCR 3 - Beta Codon-optimized/ cysteine-modified Homo sapiens (nt) |
| 26 | GCGGCCGCCACCATGGGCACCAGGCTCCTCTGCTGGGTTGTCCTGGGTTTCC<br>TAGGACAGATCACACAGGTGCTGGAGTCTCCCAGTCCCTAGGTACAAAGT<br>CGCAAAGAGAGGACAGGATAGCTCTCCAGGTGTGATCCAATTTCGGTCAT<br>GTATCCCTTTTTTGGTACCAACAGGCCCTGGGGCAGGGCCAGAGTTTCTGA<br>CTTATTTCCAGAATGAAGCTCAACTAGACAAATCGGGGCTGCCAGTGATCG<br>CTTCTTTGCAGAAAGGCCTGAGGGATCCGTCTCCACTCTGAAGATCCAGCGC<br>ACACAGCAGGAGGACTCCGCCGTGTATCTCTGTGCCAGCAGCCACCTCGCCG<br>GGTTCACCGGGGAGCTGTTTTTGGAGAAGGCTCTAGGCTGACCGTACTGGA<br>GGACCTGAAAAACGTGTTCCACCCAGAGGTCGCTGTGTTTGAGCCATCAGAA<br>GCAGAGATCTCCCACACCCAAAAGGCCACACTGGTGTGCCTGGCCACAGGCT<br>TCTACCCCGACCACGTGGAGCTGGTGGGTGAATGGGAAGGAGCCC<br>ACAGTGGGGTCTGTACAGACCCGTCAGCCCGAGCAGCCCCCTCAA<br>TGACTCCAGATACTGCCTGAGCAGCCGCCTCCGTCAAGTCCAGTTCTACGGCTCTCGG<br>CAGAACCCCGCAACCACTTCCGTCTCAAGTCCAGTTCTACGGCTCTCGG<br>AGAATGACGAGTGGACCCAGATAGGGCCAAACCTGTCACCCAGATCGTCA<br>GCGCCGAGGCTGGGGTAGAGCAGAGCTGTGGCTTCACCCTGAGTCCTTACCA<br>GGAGGGTCCTGTCTGCCACCATCCTCTATGAGATCTTGCTAGGGAAGGCC<br>ACCTTGTATGCCGTGCTGGTCAGTGCCCTCGTGCTGATGGCCATGGTCAAGA<br>GAAAGGATTCCAGAGGCCGAGAGCGGATCCGGAGCTACCAACTTCTCTGCTGAAACA | TCR 3 Codon-optimized/ cysteine-modified full sequence Homo sapiens (nt) |

| SEQ ID NO. | SEQUENCE | DESCRIPTION |
|---|---|---|
| | GGCAGGCGATGTGGAGGAAAATCTGGGCCAATGTCACTTTCTAGCCTGCTG<br>AAGGTGGTCACAGCTTCACTGTGCTAGGACCTGGCATTGCCCAGAAGATAA<br>CTCAAACCCAACCAGGAATGTTCGTGCAGGAAAAGGAGGCTGTGACTCTGG<br>ACTGCACATATGACACCAGTGATCAAAGTTATGTCTCTTCTGGTACAAGCA<br>GCCCAGCAGTGGGGAAATGATTTTTCTTATTTATCAGGGTCTTATGACGAG<br>CAAAATGCAACAGAAGGTCGCTACTCATTGAATTTCCAGAAGGCAAGAAA<br>TCCGCCAACCTTGTCATCTCCGCTTCACAACTGGGGACTCAGCAATGTATTT<br>CTGTCAATGAGAGAGGGGCGAGGCTTCAAAACTATCTTTGGAGCAGGAAC<br>AAGACTATTTGTTAAAGCAAATATCCAGAAGCCTGACCCTGCCGTGTACCAG<br>CTGAGAGACTCTAAATCCAGTGACAAGTCTGTCTGCTGTTCACCGATTTTGA<br>TTCTCAAACAAATGTGTCACAAAGTAAGGATTCTGATGTGTATATCACAGAC<br>AAATGTGTCTAGACACAAATCTGACTTTGCATGTGCAAACGCCTTCAACACAGCAT<br>CCTGAGCACAACAAATCTGACTTCTTCCCAGCCCAGAAAGTTCCTGATGTCAAG<br>CTGGTCGAGAAAGCTTTGAACAGATACGACAAGTCTAAACTTTCAAAACCTGT<br>CAGTGATTGGGTTCCGAATCCTCCTGAAAGTGGCCGGGTTTAATCTCTC<br>ATGACGCTGCGGCTGTGTCTTCCTAAGGCGCGCC | |
| 27 | MGTRLLCWVLGFLGTDHTGAGVSQSPRYKVAKRGQDVALRCDPISGHVSLF<br>WYQQALGQGPEFLITYFQNEAQLDKSGLPSDRFFAERPEGSVSTLKIQRTQQEDS<br>AVYLCASSHLAGFTGELFFGEGSRLTVLEDLKNVFPPEVAVFEPSEAEISHTQKA<br>TLVCLATGFYPDHVELSWWVNGKEVHSGVCTDPQPLKEQPALNDSRYCLSSRL<br>RVSATFWQNPRNHFRCQVQFYGLSENDEWTQDRAKPVTQIVSAFAWGRADCG<br>FTSESYQQGVLSATLYEILLGKATLYAVLVSALVLMAMVKRKDSRGGSGATNF<br>SLLKQAGDVEENPGPMSLSSLLKVTASLWLGPGIAQKITQTQPGMFVQEKEAV<br>TLDCTYDTSDQSYGLFWYKQPSSGEMIFLIYQGSYDEQNATEGRYSLNFQKARK<br>SANLVISAQLGDSAMYFCAMREGRGFKTIFGAGTRLFVKANIQKPDPAVYQLR<br>DSKSSDKSVCLFTDFDSQTNVSQSKDSDVYITDKCVLDMRSMDFKSNSAVAWS<br>NKSDFACANAFNNSIIPADTFPPSESSCDVKLVEKSFETDTNLNFQNLSVIGFRIL<br>LLKVAGFNLLMTLRLWSS | TCR 3<br>Full sequence<br>Cysteine-modified<br>Homo sapiens<br>(aa) |
| 28 | DAKTQPNSMESNEEEPVHLPCNHSTISGTDYIHWYRQLPSQGPEYVIHGLTSNV<br>NNRMASLAIAEDRKSSTLILHRATLRDAAVYYCILLVIRGTSYGKLIFGQGTILT<br>VHPNIQNPDPAVYQLRDSKSSDKSVCLFTDFDSQTNVSQSKDSDVYITDKTVLD<br>MRSMDFKSNSAVAWSNKSDFACANAFNNSIIPEDTFPPSPESSCDVKLVEKSFET<br>DTNLNFQNLSVIGPRILLLKVAGFNLLMTLRLWSS | TCR 4 - (E6)29 alpha<br>Native<br>Homo sapiens<br>(aa) |
| 29 | DAKTQPNSMESNEEEPVHLPCNHSTISGTDYIHWYRQLPSQGPEYVIHGLTSNV<br>NNRMASLAIAEDRKSSTLILHRATLRDAAVYYCILLVIRGTSYGKLIFGQGTILT<br>VHPNIQNPDPAVYQLRDSKSSDKSVCLFTDFDSQTNVSQSKDSDVYITDKCVLD<br>MRSMDFKSNSAVAWSNKSDFACANAFNNSIIPEDTFPPSPESSCDVKLVEKSFET<br>DTNLNFQNLSVIGPRILLLKVAGFNLLMTLRLWSS | TCR 4 - (E6)29 alpha<br>Cysteine-modified<br>Homo sapiens<br>(aa) |
| 30 | ATGATGGTGACAAGCATTACTGTACTCCTATCTTTGGGTATTATGGGTGA<br>TGCTAAGACCACACAGCCAAATTCAATGGAGAGTAACGAAGAAGAGCCTGT<br>TCACTTGCCTTGTAACCACTCCACAATCAGTGGAACTGATTACATACATGGT<br>ATCGACAGCTTTCCCTCCCAGGGTCCAGAGTACGTGATTCATGGTCTTACAAG<br>CAATGTAACAACAGGCCCTCCTGGCAATGCTGCTAGACAGAAAGTC<br>CAGTACCCTTGATCCTGCACCGTGCACCTTGAGAGATGCTGCTGTACTACT | TCR 4 - (E6)29 alpha<br>Native<br>Homo sapiens<br>(nt) |

SEQUENCE TABLE-continued

| SEQ ID NO. | SEQUENCE | DESCRIPTION |
|---|---|---|
| | GCATCCTACTGGTAATCCGTGGTACTAGCTATGGAAAGTGGACA<br>AGGGACCATCTGACTGCTGTCCATCCAAATATCCAGAACCCTGCCGTG<br>TACCAGCTGAGAGACTCTAAATCCAGTGACAAGTCTGTCTGCCTATTCACCG<br>ATTTTGATTCTCAAACAAATGTGTCACAAGTAAGGATTCTGATGTGTATATC<br>ACAGACAAAACTGTGCTAGACATGAGGTCTATGGACTTCAAGAGCAACAGT<br>GCTGTGGCCTGGAGCAACAAATCTGACTTTGCATGTGCAAACGCCTTCAACA<br>ACAGCATTATTCCAGAAGACACCCTTCTCCCAGCCAGAAAGTTCCTGTGA<br>TGTCAAGCTGTGCAGAAAAGCTTTGAAACAGATACGAACCTAAACTTTCAA<br>AACCTGTCAGTGATTGGGTTCCGAATCCTCCTCTGAAAGTGGCGGGTTTA<br>ATCTGCTCATGACGCTGCGGCTG | |
| 31 | ATGAAACTGGTGACCAGCATCACAGTTCCTGCTCCTGGGAATTATGGGGCG<br>ACGCAAGACACCACAGCTCAACTTCAACTTCAGTGAGAGTAATGAGGAAGAGCCTG<br>TGCCACCTGCCATGTAACCATTCAACTTACCTGGCACCGATTACATTCACTG<br>GTATCGCCAGTGCCCTCCAGGACCTGAATACGTGATCCATGGCCTGACC<br>TCAAATGTCAACAATCGCATGGCTAGCCTGGCTATCGCAGAGGACCGAAAGT<br>CAAGCACCCTGATTCTGCACCGAGCCACACTGCGAGATGCCAGCCGTGACTA<br>TTGCATCCTGGTCATTAGAGGGACCAGCTACGGAAAACTGACATTGGC<br>CAGGGACTATATCCTGACCGTGCATCCTAACATTCAGAATCCCGACCCTGCCG<br>TGTATCAGCTGAGGGACTCTAAGTCCTCTGATAAAAAGCGTGCCTGTTCAC<br>TGACTTTGATTCCCAGACCAACGTGTCCAGTTCAAGCCAGCATGGACTTCAAGAGTAACT<br>ATCAGACAAATATGCTTCTGGATATGCCAGCATGGCAGTTCAAGAGTAACT<br>CAGCCTGGCTTGCCAACAAGTCTGATTTCGCATGCCAACGCTTTTAA<br>CAACAGTATCATCCCAGAAGATACCTTCTTTCCATCACCCGAGAGTTCATGT<br>GACTGAAGCTGGTCGAAAAATCTTTCAGGATTCTGCTGAAGGTCGCCGATT<br>AGAACCTGAGTGTGATCGGGTTCAGGATTCTGCTGAAGGTCGCCGATT<br>CAATCTGCTGATGACGCTGCGCCCTGTGGAGCTCC | TCR 4 – (E6)29 alpha<br>Codon-optimized/<br>cysteine-modified<br>Homo sapiens<br>(nt) |
| 32 | DTGVSQDPRHKITKRGQNVTFRCDPISEHNRLYWYRQTLGQGPEFLTYFQNEAQ<br>LEKSRLLSDRFSAERPKGSFSTLEIQRTEQGDSAMYLCASSPGGGNTEAFFGQGT<br>RLTVVEDLNKVFPPEVAVFEPSEAEISHTQKATLVCLATGFFPDHVELSWWVNG<br>KEVHSGVSTDPQPLKEQPALNDSRYCLSSRLRVSATFWQNPRNHFRCQVQFYGL<br>SENDEWTQDRAKPVTQIVSAEAWGRADCGFTSVSYQQGVLSATIIYEILLGKAT<br>LYAVLVSALVLMAMVKRKDF | TCR 4 – (E6)29 Beta<br>Native<br>Homo sapiens<br>(aa) |
| 33 | DTGVSQDPRHKITKRGQNVTFRCDPISEHNRLYWYRQTLGQGPEFLTYFQNEAQ<br>LEKSRLLSDRFSAERPKGSFSTLEIQRTEQGDSAMYLCASSPGGGNTEAFFGQGT<br>RLTVVEDLNKVFPPEVAVFEPSEAEISHTQKATLVCLATGFFPDHVELSWWVNG<br>KEVHSGVCTDPQPLKEQPALNDSRYCLSSRLRVSATFWQNPRNHFRCQVQFYGL<br>SENDEWTQDRAKPVTQIVSAEAWGRADCGFTSVSYQQGVLSATIIYEILLGKAT<br>LYAVLVSALVLMAMVKRKDF | TCR 4 – (E6)29 Beta<br>Cysteine-modified<br>Homo sapiens<br>(aa) |
| 34 | ATGGGCACCAGCCTCCTCTGCTGGATGGCCCTGTGCCTGTCTGGGGCAGATC<br>ACGCAGATACCTGGAGTCTCCCAGACCCAGACACAGAGATCACAAGAGGG<br>GACAGAATGTAACTTTCAGTGTGATCCAATTTCTGAACACAACCGCCTTTA<br>TTGGTACCGACAGACCCTGGGCAGGGGCCCAGAGTTTCGACTTACTTCCAG<br>AATGAAGCTCAACTAGAAAAATCAAGGCTGCTCAGTGATCGGTTCTCTGCAG<br>AGAGGCCTAAGGGATCTTTCTCCACCTTGGAGATCCAGCGCACAGAGCAGGG<br>GGACTCGGCCATGTACTGTGCCAGCAGCCCCGGCGGGGGACACTGAA | TCR 4 – (E6)29 Beta<br>Native<br>Homo sapiens<br>(nt) |

SEQUENCE TABLE-continued

| SEQ ID NO. | SEQUENCE | DESCRIPTION |
|---|---|---|
|  | GCTTTCTTTGGACAAGGCACCAGACTCACAGTTGTAGAGAGACCTGAACAAGG<br>TGTTCCACCCGAGTCGCTGTGTTTGAGCCATCAGAAGCAGAGATCTCCCA<br>CACCCAAAAGCCACACTGGTGTGCCTGGCCACAGGCTTCTTCCCTGACCAC<br>GTGGAGCTGAGCTGGTGTGGTGAATGGGAAGGAGGTGCACAGTGGGGTCAGC<br>ACGGACCCGCAGCCCCTCAAGGAGCAGCCCGCCTCAATGACTCCAGATACT<br>GCCTGAGCAGCCGCCTGAGGGTCTCGGCCACCTTCTGGCAGAACCCCGCAA<br>CCACTTCCGTCTGTCAAGTCCAGTTCTACGGGCTCTCGAGAATGACGAGTGG<br>ACCCAGGATAGGGCCAAACCGTCACCCAGATCGTCAGCGCCGAGGCCTGG<br>GGTAGAGCAGACTGTGGCTTTACCTCGGTGTCCTACCAGCAAGGGGTCTGT<br>CTGCCACCATCCTCTATGAGATCCTGCTAGGGAAGGCCACCCTGTATGCTGT<br>GCTGGTCAGCGCCCTTGTGTTGATGGCCATGGTCAAGAGAAAGGATTTC |  |
| 35 | ATGGGGACTAGCCTGTGTCTGTGCTGTGATGGCTACTGTCCTGCTGTGGAGCAGACC<br>ACGCAGATACCGGAGTCGAGCCAGGACCCCAAGACATAAGATCACAAAAGGG<br>GCCAGAACGTGACTTTAGATGCGATCCCATTAGCGACAACAATAGACTGTA<br>CTGGTATAGGCAGACACTGGGACAGGGACACAGAGTTCCTGACTTACTTTCAG<br>AACGAAGCTCAGCTGGAGAAGAGTCGCCTGCTGTCAGACCGGTTCAGCGCC<br>GGGGATTCCCCATGTATCTGTGCGCTAGCTCCCCAGGAGGAGGAAACACCG<br>AAGCCTTCTTTGGACAGGCACACGGTCACTGTGTGTGGAGGACCTGAATAA<br>GGTGTTCCCCCTGAAGTGGCCCGTCTTTGAGCCTTCCGAAGCTGAGATTTCTC<br>ACACCCAGAAGCCACCCTGGTGTGCCTGGCAACAGGCTTCTTTCCAGATCA<br>CGTGGAACTGCAGTGTGGGTCAACGGAAAGGAGGTGCATAGCGCGTCTG<br>CACTGACCCCACAGCCCCTGAAAGACAGCCGCACTCCAGTGAATGACAGGTA<br>CTGCCTGTCTAGTCGGCTCAGGTGCAGTTTTATGGCTGTCCCGAAAACGACGAGT<br>AATCATTTCCGCTGTCAGGCTCGGGCCAAGCCCGTGACCCAGATCGTCTCGCAGAAGCTG<br>GGGCAGAGCTGACTGCGGGTTCACCTCAGTGAGCTACCAGCAGGAGTCCTG<br>TCCGCTACCATCCTGTACGAGATTCTGCTGGGCAAGGCTACACTGTATGCAG<br>TGCTGGTCTCGCACTGGTGCTGATGGCCATGGTCAAGCCAAAGACTTC |  TCR 4 - (E6)29 Beta<br>Codon-optimized/<br>cysteine-modified<br>Homo sapiens<br>(nt) |
| 36 | GCGGCCGCCACCATGGGACTAGCCTGCTGCTGTGATGGCACTGTGCCTGC<br>TGGAGCAGACCACCAGATACCGGAGTCGAGCCAGGACCCAAGACATAAGA<br>TCACAAAAGGGGCCAGAACGTGACTTTTAGATGCGATCCCATTAGCGACAACA<br>CAATAGACTGTACTGGTATAGGCAGACACTGGGACAGGGACACAGAGTTCCT<br>GACTTACTTTCAGAACGAAGCTCAGCTGGAGAAGAGTCGCCTGCTGTCAGAC<br>CGGTTCAGCGCCGGGGATTCCCCATGTATCTGTGCGCTAGCTCCCCAGGAGG<br>AGGAAACACCGAAGCCTTCTTTGGACAGGGCACACGGTCACTGTGGTCGA<br>GGACCTGAATAAGGTGTTCCCCTGAAGTGGCCGTCTTTGAGCCTTCCGAA<br>GCTGAGATTTCTCACACCCAGAAGCCACCCTGGTGTGCCTGGCAACAGGCT<br>TCTTTCCAGATCACGTGGAACTGCAGTGGTGGGTCAACGGAAAGGAGGTGCA<br>TAGCGGCGTCTGCACTGACCCCACAGCCCCTGAAAGACAGCCGCACTGAAT<br>GATAGGTACTGCCTGCTCAGTCGCCTGTCAGTGAGCTACCAGCAGGATCCTG<br>AGAACCCTAGAATCATTTCCGCTGTCAGGCTCGGGCCAAGCCCGTGACCCAGATCGTCTCT<br>AAACGACGAGTGGACTGCGGGGTTCACCTCAGTGACGCTA<br>GCAGAAGCTGGCAGAGCTGACTGCGGGGTTCACCTCAGTGAGCTACCAG<br>CAGGAGTCCTGTCCGCTACCATCCTGTACGAGATTCTGCTGGGCAAGGCTA<br>CACTGTATGCAGTGCTGGTCTCTGCACTGGTGCTGATGGCCATGGTCAAGCG | TCR 4 - (E6)29<br>Codon-optimized/<br>cysteine-modified full<br>sequence<br>Homo sapiens<br>(nt) |

| SEQ ID NO. | SEQUENCE | DESCRIPTION |
|---|---|---|
| | CAAAGACTTCGGGAGTGGAGCAGCAAACAAACTTTTCACTGCTGAAGCAGGCCGG<br>CGATGTGGAGGAAATCCTGGGCAATGAAACTGTGACCAGCATCAACTAACCTCT<br>CCTGCTGTCCTGGGAATTATGGGCAAGACGCCAAGACCACACAGCCTAACTCT<br>ATGGAGAGTAATGAGGAAGAGCCTGTGCACCTGCCATGTAACCATTCAACTA<br>TCAGCGGCACCGATTACATTCACTGGCTGACCTGATCGCAGCTGCCCTCCAGGGACC<br>TGAATACGTGATCCATGGCCTCAGCCGAAAGTCAAATGTCAACAATGCATGGCTAGC<br>CTGGCTATCCAGAGACCCAAGAGCCTGAATTCTGCACCGAGCCA<br>CACTGCGAGATGCAGCCGTGTACATTTGCCAGGGACTATCCTGACCGTGCATCCT<br>CAGCTACGGAAAACTGACATTTGCCAGGGACTATCAGCTGAGGACTCTAAGTCCT<br>AACATTCAGAATCCCGACTTGCCTGTATCAGCTGAGGGACTCCTAAGTCCT<br>CTGATAAAGCGTGTGCCTGTTCACTGACTTTGATTCCCAGACCAACGTGTCC<br>CAGTCTAAGGACTCTGACGTGTACATCACAGACAAATGCCTCCTGATATGC<br>GCAGCATGGACTCTCAAGAGTAACTCAGCCGTGGCTTGGTCCAACAAGTCTGA<br>TTTCCATGCGCCAACGCTTTAACAACAGTATCATCCCAGAAGATACCTTCT<br>TTCCACCCGAGAGTTCATGTGACGTGAAGTCGTCGAAAAATCTTTCGA<br>GACTGATACCAACCTGAATTTCAGAACCTGAGTGTGATCGGTTCAGGATT<br>CTGCTGCTGAAGGTCGCCGGATTCAATCTGTCTGATGACACTGCGCCTGTGGA<br>GCTCCTGAGGGCGCC | |
| 37 | MGTSLLCWMALCLLGADHADTGVSQDPRHKITKRGQNVTFPRCDPISEHNRLYW<br>YRQTLGQGPEFLTYFQNEAQLEKSRLLSDRFSAERPKGSFSTLEIQRTEQGDSAM<br>YLCASSPGGGNTEAFFGQGTRLTVVEDLNKVFPPEVAVFEPSEAEISHTQKATLV<br>CLATGFFPDHVELSWWVNGKEVHSGVCTDPQPLKEQPALNDSRYCLSSRLRVS<br>ATFWQNPRNHFRCQVQFYGLSENDEWTQDRAKPVTQIVSAEAWGRADCGFTS<br>VSYQQGVLSATILYEILLGKATLYAVLVSALVLMAMVKRKDFGSGATNFSLLKQ<br>AGDVEENPGPMKLVTSITVLLSLGIMGDAKTTQPNSMESNEEEPVHLPCNHSTIS<br>GTDYIHWYRQLPSQGPEYVIHGLITSNVNNRMASLAIAEDRKSSTLILHRATLRDA<br>AVYYCILLLVIRGTSYGKLITFGQGTILTFHPNIQNPDPAVVQLRDSKSSDKSVCLFT<br>DFDSQTNVSQSKDSDVYITDKCVLDMRSMDFKSNSAVAWSNKSDFACANAFNN<br>SIIPEDTFFPSPESSCDVKLVEKSFETDTNLNFQNLSVIGFRILLLKVAGFNLLMTL<br>RLWSS | TCR 4 – (E6)29<br>Full sequence<br>Cysteine-modified<br>Homo sapiens<br>(aa) |
| 38 | AQKITQTQPGMFVQEKEAVTLDCTYDTSDQSYGLFWYKQPSSGEMIFLIYQGSY<br>DEQNATEGRYSLNFQKARKSANLVISASQLGDSAMYFCAMREGTGTSYGKLTF<br>GQGTILTVHPNIQNPDPAVVQLRDSKSSDKSVCLFTDFDSQTNVSQSKDSDVYIT<br>DKTVLDMRSMDFKSNSAVAWSNKSDFACANAFNNSIIPEDTFFPSPESSCDVKL<br>VEKSFETDTNLNFQNLSVIGFRILLLKVAGFNLLMTLRLWSS | TCR 5 – (E6)29 – TCR<br>alpha<br>Native<br>Homo sapiens<br>(aa) |
| 39 | AQKITQTQPGMFVQEKEAVTLDCTYDTSDQSYGLFWYKQPSSGEMIFLIYQGSY<br>DEQNATEGRYSLNFQKARKSANLVISASQLGDSAMYFCAMREGTGTSYGKLTF<br>GQGTILTVHPNIQNPDPAVVQLRDSKSSDKSVCLFTDFDSQTNVSQSKDSDVYIT<br>DKCVLDMRSMDFKSNSAVAWSNKSDFACANAFNNSIIPEDTFFPSPESSCDVKL<br>VEKSFETDTNLNFQNLSVIGFRILLLKVAGFNLLMTLRLWSS | TCR 5 – (E6)29 – TCR<br>alpha<br>Cysteine-modified<br>Homo sapiens<br>(aa) |
| 40 | ATGTCACTTTCTAGCCTGCTGAAGTGGTCACAGTTCACTGTGCTAGGAC<br>CTGGCATTGCCCAGAAGATAACTCAACCCAACCAGCAATGTTCGTGCAGGA<br>AAAGGAGGCTGTGACTCTGGACTGCACATATGACACCAGTGACCAGAGTTAT<br>GGTCTATTCTGGTACAAGCAGCCCAGCAGTGGGGAAATGATTTTCTTATTTA<br>TCAGGGTCTTATGACGAGCAAAATGCAACAGAAGGTCGCTACTCATTGAAT | TCR 5 – (E6)29 – TCR<br>alpha<br>Native<br>Homo sapiens<br>(nt) |

SEQUENCE TABLE-continued

| SEQ ID NO. | SEQUENCE | DESCRIPTION |
|---|---|---|
| | TTCCAGAAGGCAAGAAAATCCGCCAACCTTGTCATCTCCGCTCACAACTGG GGGACTCAGCAGTCTCTGTGCAATGAGAGAGGGCACAGGTACTAGCTA TGGAAAGCTGACATTTGGACAAGGACCATCTGACTGTCATCCAAATATC CAGAACCCTGACCCTGCCGTGACCAGCTGAGAGACTCTAAATCCAGTGACA AGTCTGTCTGCCTATTCACCGATTTTGATTCTCAAACAAATGTGTCACAAAGT AAGGATTCTGATGTGTATATCACAGACAAAACTGTGCTAGACATGAAGGTCTA TGGACTTCAAGAGACAACAGTGTCTGCCTGGACAACAAATCTGACTTTGC ATGTCAAACGCCTTCAACAACAGCATTATTCCAGAAGACACCTTCTTCCCC AGCCCAGAAACGTTCCTGTGATGTCAAGCTGGTCAGTATTGGGTTCCAGAACAG ATACGAACCTAAACTTCAAAACTGTCTCAGTGATTGGTTCCGAATCCTCCTC CTGAAAGTGCCGGGTTTAATCTGCTCATGACGCTGCGGCTG | |
| 41 | ATGAGTCTCTGTCTCTGCTGAAGGTGGTCACTCAGTCTCCGCTTCATCACTGTGGACCAGGA CAGGAATCGCACAGAAAATTACCCACAGCTGACATGTTTGTCCAGGA GAAGGAGCGTGACCCTGAGCTGTACTTACGACACCAGGATCTCCTAC GGCCGTGTTTTGGTATAAGCAGCCAAGTTCAGGAGAGATGATCTTCCTGATCT ACCAGGGCAGCTATGACGAGCAGACGCTACAGAAGGCAGGTATGCCTGA ATTTCCAGAAAGCCCGCTAACCTGGTCATCTGCCAGTCAGCT GGGGATTCTGCCATGTACTTTGCGCTATGAGGGAGGAACTGGCACCAGC TATGGAAAGCTGAACTTCAGACACCTGCCGTGACCACCTGCCAGACGTAAGGCTCCGA TTCAGAATCCAGACCTGCCGTGACCACCTGTTGCAGCTGCGAGACAGTAAAGCTCCGA TAAGAGCGTGTCCTGTCTGCTTTACAGACTTTGATTCTCAGATAACGTGAGCCAG AGCAACAAGCCTGATGCTCTATATACCGACAAGTGCCGTGCTGAATATGCCCA GCATGACTTTAAATCCAACTCTGCAGTGCCTGGTCTAATAAGAGTGATTT CGCTTGCCGAAACGCCTTTAACAGTCCTTTAACAATTCAATCAATTCCCGAGGATACCTTCTTC CAAGCCCCGAATCTAGTTGTGACCTGAAACTGAAACTCGGTTCATCGGTTCCGGATTCTGC AGATACTAACCTGAATTTTCAAGATTTTGAGTTCAAGATCCATCAGGTTCATCGGTTCCGGATTCTGC TGCTGAAGGTGGCCGGGTTCAACCTGCTGATGACCCTGAGACTGGTCAAG C | TCR 5 - (E6)29 - TCR alpha Codon-optimized/ cysteine-modified Homo sapiens (nt) |
| 42 | DVKVTQSSRYLVKRTGEKVFLECVQDMDHENMFWYRQDPGLGLRLIYFSYDV KMKEKGDIPEGYSVSREKKERFSLILESASTNQTSMYLCASSPWGETHQPQHFG DGTRLSILEDLNKVFPPEVAVFEPSEAEISHTQKATLVCLATGFFPDHVELSWWV NGKEVHSGVSTDPQPLKEQPALNDSRYCLSSRLRVSATFWQNPRNHFRCQVQFY GLSENDEWTQDRAKPVTQIVSAEAWGRADCGFTSVSYQQGVLSATILYEILLGK ATLYAVLVSALVLMAMVKRKDF | TCR 5 - (E6)29 - TCR beta Native Homo sapiens (aa) |
| 43 | DVKVTQSSRYLVKRTGEKVFLECVQDMDHENMFWYRQDPGLGLRLIYFSYDV KMKEKGDIPEGYSVSREKKERFSLILESASTNQTSMYLCASSPWGETHQPQHFG DGTRLSILEDLNKVFPPEVAVFEPSEAEISHTQKATLVCLATGFFPDHVELSWWV NGKEVHSGVCTDPQPLKEQPALNDSRYCLSSRLRVSATFWQNPRNHFRCQVQF YGLSENDEWTQDRAKPVTQIVSAEAWGRADCGFTSVSYQQGVLSATILYEILLG KATLYAVLVSALVLMAMVKRKDF | TCR 5 - (E6)29 - TCR beta Cysteine-modified Homo sapiens (aa) |
| 44 | ATGGGAATCAGGCTCCTCTGTCGTGTGGCCTTTTGTTTCCTGGCCTGTGAGGCCT CGTAGATGTGAAAGTAACCCAGAGCTCGAGATATCTAGTCAAAGGACGGG AGAGAAAGTTTTCTGGAATGTGTCCAGGATATGGACCATGAAAATATGTTC TGGTATCGACAAGACCCAGGTCTGGGGCTACGGCTGATCTATTTCTCATATG ATGTTAAAATGAAGAAAAGGAGATATTCCTGAGGGGTACAGTGTCTCTA | TCR 5 - (E6)29 - TCR beta Native Homo sapiens (nt) |

SEQUENCE TABLE-continued

| SEQ ID NO. | SEQUENCE | DESCRIPTION |
|---|---|---|
| | GAGAGAAGAAGGAGGCGCTTCTCCTGATTCTGAGTCCGCAGCACCAACCA GACATCTATGTACCTCGTGCCAGCCCATGGGAGAAACTCATCAGCCC CAGCATTTTGTGATGGACTCGACTTCTCCATCCTAGAGGACCTGAACAAGG TGTTCCCACCCGAGTCGCTGTGTTTGAGCCATCAGAGCAGAGATCTCCCA CACCCAAAAGGCCACACTGGTGTGCCTGGCCACAGGCTTCTTCCCTGACCAC GTGGAGCTGTGTGGTGAATGGGAAGGAGGTGCACAGTGGGGTCAGC ACGGACCCCGAGCCCCTCAAGGAGCACCCCGCCCTCAATGACTCCAGATACT GCCTGAGCAGCCGCCTGAGGGTCTCGGCCACCTTCTGGAGAACCCCGCAA CCACTTCCGCTGTCAAGTCCAGTTCTACCGGCTCACCCCAGATCGTCAGCGCCTGG ACCCAGGATAGGGCCAAACCCGTCACCCAGATCTCAGCGCCGAGGCCTGG GGTAGACAGACTGTGGCTTTACCTCGGTGTCTACCAGCAAGGGTCCTGT CTGCCACCATCCTCTATGAGATCCTCTAGGGAAGGCCACCCTGTATGCTGT GCTGGTCAGCGCCCTTGTGTTGATGGCCATGGTCAAGAGAAAGGATTTC | |
| 45 | ATGGGAATCAGGCTCCTCTGTCGTGTGCCTGCATTCTGTTTCTGGCCTGGGCCT GGTGGACGTGAAAGTGACTCAGAGCTCCAGATACCTGGTGAAAAGGACCGG CGAGAAGGTCTTTCTGGAATGCGTGCAGGACATGGATCACGAGAATATGTTC TGGTATCGGCAGGATCCAGGCCTGGGGCTGAGACTGATTTACTTTCCTATG ATGTGAAGATGATAAAGAGAAGGGCGACATTCCCGAAGGGTACTCCGTGTCTC GCGAGAAGAAGAACGATTCAGCCTGATCCTGGAGAGTGCTTCAACCAATC AGAACATCCATGTATCTGTGCGCCATCCAGTCTCTTGGGGCGAGACACCAGCC ACAGCATTTCGGAGATGGCACTCGGCTGAGCATCCTGAAGACCTGAACAA AGTGTTCCCCCTGAGGTCCCCGTGTTCCAAGCCTTCAGAGGTCAGAAATTAGC CACACTCAGAAGGCCACCCTGGTGTGCCTGGCCACTGGCTTCTTTCCAGACC ACGTCGAGCTGTCCTGGTGGGTGAATGGAGAGCAGCCCGCACTGAACGATTCCAGAT ACTGCCTGAGTTCCGGCTTCTGCGAAGACCTGAGTAGCCCACTTTTTGCAGAACCCTCG AAATCATTTCGGGTCAAGAGCCAAACCTGTCACACAGATCGTCTCTACCAGCAGGGCGTTGCT TGGACCCAGGATGCAGCGCCAAACCTGTCACACAGATCGTCTCCTACCAGCAGGGGCGTGCT GGGGACGCGCTGATTGGGCTTCACCAAGGCTCTCCTACAGCAGGGCGTGCT GTCTGCCACCATCCTGTACGAAATTCTGCTGGGAAGCATCTGTATGCC GTGCTGGTGAGCGCCCTGGTGCTGATGGCAATGGTGAAAAGGAAGGACTTC | TCR 5 - (E6)29 - TCR beta<br/>Codon-optimized/<br/>cysteine-modified<br/>Homo sapiens<br/>(nt) |
| 46 | GCGGCCGCCACCATGGGAATCAGGCTGCTGTGCCGCGTGCATCCATTCTGTTTTCT GGCCTGGGCCTGGTGGACGTGAAAGTGACTCAGAGCTCCAGATACCTGGTG AAAAGGACCGGCGAGAAGGTCTTTCTGGAATGCGTGCAGGACATGGATCAC GAGAATATGTTCTGGTATCGCAGGATCCAGGCCTGGGGCTGAGACTGATCT ACTTTCCTGTCTATGATGTGAAGATGATAAAGAAGAACGATTCAGCCTGATCCTGGAGAGTGCT TCAACCAATCAGAACATCCATGTATCTGTGCGCCATCCAGTCTCTTGGGCGAGA CACCAGCCACAGCATTTCGGAGATGGCACTCGGCTGAGCATCCTGAAGCA CCTGAACAAAGTTTCCCCCCTGAGGTCCCGAGGTCCTGGTGTTCGAACCTTCAGAGGCA GAAATTAGCCACACTCAGAAGGCCACCCTGGTGTGCCTGGCCACTGGCTTCT TTCCAGACCACGTCGAGCTGTCCTGGTGGGTGAATGGAAAGAAGTCCATAG TGGAGTGTGACCGACCCAGCCCCTGAAGGAGCAGCCCGCACTGAACGA TTCCAGATACTGCCTGTCAAGCCGGCTCAGGTGCAGTTTTATGCCTGAGCGAGA ACCCTCGAAATCATTTCCGGTGTCAGCCAAACCTGTCACACAGATCGTGTCCG CCGAGGCTTGGGACGCGCTGATTGCGGCTTCACAAGCCTCTCCTACCAGCA | TCR 5 - (E6)29 - TCR<br/>Codon-optimized/<br/>cysteine-modified full<br/>sequence<br/>Homo sapiens<br/>(nt) |

| SEQ ID NO. | SEQUENCE | DESCRIPTION |
|---|---|---|
| | GGGCCTGCTGCTCTGCCACCATCCTGTACGAAATTCTGCTGGGAAGGCTACA<br>CTGTATGCCCTGGTCCGTGGTCGAGCGCCCTGGTCTGATGGCAATGGTGAAAAGGA<br>AGGACTTCGGCTCCGAGCCCACACAAATTTTCTCTGCTGAAACAGCTGGGGA<br>TGTGGAGGAAAACCCTGGGCTGGGACTCGTGTGTCTCTGCTGAAGGTGGTC<br>ACTGCATCACTGTGCTGGGACCAGGAATCGCACAGAAATTACCAGACA<br>CAGCCTGCATGTTTGTCCAGGAGAAGGAAGCCGTGACCTGGACTGTACTT<br>ACGACACAGCATCAGTCCTACGGCCTGTTTTGTATAAGCAGCCAAGTTC<br>AGGAGAGATGATCTTCCTGATCTACCAGGGCAGCTATGACGAGCAGAACCGT<br>ACAGAAGGCAGGTATAGCCTGAATTTCCAGAAAGCCCGACCAAGTCCGCTAAC<br>CTGGTCATCTCTGCCAGTCAGCTGGGGATCTGCCATGTACTTTTGCGCTAT<br>GAGGGAGGGAACCTGCACCAGCTATGAAGCTGACCTTCGGGCAGGGAAC<br>AATCCTGACTGTCCATCCCAACATTCAGAATCCAGACCCTGCCGTGTACCAG<br>CTGCCAGACAGTAAAGCTCCGATAAGAGCGTGCCTGTTCACAGACTTTG<br>ATTCTCAGACATAAACGTGAGCCAGGACAAAGACAGTGATGCTATATTACCGA<br>CAAGTGCGTCTGGATATGCGACAGCTGACTTTAAATCCAACTCTGCAGTG<br>GCCTGTCTAATAAGACTGATTTCCTTGCGCAAACGCCTTTAACAATTCAA<br>TCATTCCCGAGGATACCTCTTTCCAAGCCCCGAATCTAGTTGTGACGTGAAA<br>CTGGTGGAAGAGTCTTTCGAAACAGATACTAACCTGAATTTTCAGAATCTGA<br>GTGTCATCGGTTTCCGAATTCTGCTGCTGAAGGTGGCCGATTCAACCTGCT<br>GATGACCCTGAGACTGTGGTCAAGCTGAGGCGCGCC | |
| 47 | MGIRLLCRVAFCFLAVGLVDVKVTQSSRYLVLKRTGEKVFLECVQDMDHENMF<br>WYRQDPGLGLRLIYFSDVKMKEKGDIPEGYSVSREKKERFSLILESASTNQTSM<br>YLCASSPWGETHQPQHFGDGTRLSILEDLNKVFPPEVAVFEPSEAEISHTQKATL<br>VCLATGFFPDHVELSWWVNGKEVHSGVCTDPQPLKEQPALNDSRYCLSSRLRV<br>SATFWQNPRNHFRCQVQFYGLSENDEWTQDRAKPVTQIVSAEAWGRADCGFTS<br>VSYQQGVLSATILYEILLGKATLYAVLVSALVLMAMVKRKDFGSGATNFSLLKQ<br>AGDVEENPGPMSLSLLFWYKQPSSGEMIFLIYQGSYDEQNATEGRYSLNFQKARKSANLV<br>YDTSDQSYGLFWYKQPSSGEMIFLIYQGSYDEQNATEGRYSLNFQKARKSANLV<br>ISASQLGDSAMYFCAMREGTGTSYGKLITFGQGTILLTVHPNIQNPDPAVYQLRDS<br>KSSDKSVCLFTDFDSQTNVSQSKDSDVYITDKCVLDMRSMDFKSNSAVAWSNK<br>SDFACANAFNNSIIPEDTFFPSPESSCDVKLVEKSFETDTNLNFQNLSVIGFRILLL<br>KVAGFNLLMTLRLWSS | TCR 5 - (E6)29 - TCR<br>Full sequence<br>Cysteine-modified<br>Homo sapiens<br>(aa) |
| 48 | GEDVEQSLFLSVREGDSSVINCTYTDSSSTYLYWKQEPGAGLQLLTYIFSNMD<br>MKQDQRLTVLLNKKDKHLSLRIADTQTGDSAIYFCAESIRGFGNVLHCGSGTQV<br>IVLPHIQNPDPAVYQLRDSKSSDKSVCLFTDFDSQTNVSQSKDSDVYITDKTVLD<br>MRSMDFKSNSAVAWSNKSDFACANAFNNSIIPEDTFFPSPESSCDVKLVEKSFET<br>DTNLNFQNLSVIGFRILLLKVAGFNLLMTLRLWSS | TCR 6 - Alpha<br>Native<br>Homo sapiens<br>(aa) |
| 49 | GEDVEQSLFLSVREGDSSVINCTYTDSSSTYLYWKQEPGAGLQLLTYIFSNMD<br>MKQDQRLTVLLNKKDKHLSLRIADTQTGDSAIYFCAESIRGFGNVLHCGSGTQV<br>IVLPHIQNPDPAVYQLRDSKSSDKSVCLFTDFDSQTNVSQSKDSDVYITDKCVLD<br>MRSMDFKSNSAVAWSNKSDFACANAFNNSIIPEDTFFPSPESSCDVKLVEKSFET<br>DTNLNFQNLSVIGFRILLLKVAGFNLLMTLRLWSS | TCR 6 - Alpha<br>Cysteine-modified<br>Homo sapiens<br>(aa) |
| 50 | ATGAAGACATTGCTGGATTTTCGTTCCTGTTTTTGTGGCTGCAGCTGACTG<br>TATGAGTAGGAGGAGGATGTGGAGCAGAGTCTTTTCCTGAGTGCCGAGAG | TCR 6 - Alpha<br>Native |

| SEQ ID NO. | SEQUENCE | DESCRIPTION |
|---|---|---|
| | GGAGACAGCTCCGTTATAAACTGCACTTACACAGACAGCTCCTCCACCTACT TATACTGGTATAAGCAAGAACCTGAGCAGTTCTCCAGTTGCTGACGTATAT TTTTTCAAATATGGACATGGAAACAAGACCAAAGACTCACTGTTCTATTGAAT AAAAAGGATAAACATCTGTCTCTGCAGAGAGTATAGAGGCTTTGGGACTGCA CAGCTATCTACTTCTGTGCAGAGAGTATTGTTTTACCACATATCCAGAACCTGAC CCTGCCGTGTACCAGTTGAGAGCTCTAAATCCAGTGACAGTCTGTCTGCC TATTCACCGATTTTGATTCTCAAACAAATGTCTCAAAGTAAGGATTCTGAT GTGTATATCACAGACAAACTGTCGAGCAACAAATCTGACTTGCATGTCAAACGC CTTCAACAACAGCATTATTCCAGAGACACACCTCTTCCCCAGAAGCT TCCTGTGATGTCAAGCTGGTCGAGAAAGCTTTGAAACAGATACCGAACCTAA ACTTTCAAAACCTGTCAGTGATTGGGTTCCGAATCCTCCTGAAAGTGGCC GGGTTTAATCTGCTCATGACGCTGCGGCTG | Homo sapiens (nt) |
| 51 | ATGAAGACATTTGCTGGAGGAGGATGTGAGCAGGACTCTTTTCTGAGTGTCCGAGAG GGAGACAGCTCCGTTATAAACTGCACTTACACAGACAGCTCCTCCACCTACT TATACTGGTATAAGCAAGAACCTGAGCAGTTCTCCAGTTGCTGACGTATAT TTTTTCAAATATGGACATGAAACAAGACCAAAGACTCACTGTTCTATTGAAT AAAAAGGATAAACATCTGTCTCTGCAGAGAGTATAGAGGCTTTGGGACTGCA CAGCTATCTACTTCTGTGCCACTCAAGTGATTGTTTTACCACATATCCAGAACCTGAC CCTGCCGTGTACCAGTTGAGAGCTCTAAATCCAGTGACAGTCTGTCTGCC TATTCACCGATTTTGATTCTCAAACAAATGTCTCAAAGTAAGGATTCTGAT GTGTATATCACAGACAAACTGTGCGAGCAACAAATCTGACTTGCATGTCAAACGC CTTCAACAACAGCATTATTCCAGAGACACACCTCTTCCCCAGAAGCT TCCTGTGATGTCAAGCTGGTCGAGAAAGCTTTGAAACAGATACCGAACCTAA ACTTTCAAAACCTGTCAGTGATTGGGTTCCGAATCCTCCTGAAAGTGGCC GGGTTTAATCTGCTCATGACGCTGCGGCTGTCTTCC | TCR 6 - Alpha Codon-optimized/ cysteine-modified Homo sapiens (nt) |
| 52 | EPEVTQTPSHQVTQMGQEVILRCVPISNHLYFWYWRQILGQKVEFLVSFYNNEIS EKSEIFDDQPSVERPDGSNFTLKIRSTKLEDSAMYFCASTTRSSYEQYFGPGTRLT VTEDLKNVFPPEVAVFEPSEAEISHTQKATLVCLATGFYPDHVELSWWVNGKEV HSGVSTDPQPLKEQPALNDSRYCLSSRLRVSATFWQNPRNHFRCQVQFYGLSEN DEWTQDRAKPVTQIVSAEAWGRADCGFTSESYQQGVLSATILYEILLGKATLYA VLVSALVLMAMVKRKDSRG | TCR 6, TCR 12 - Beta Native Homo sapiens (aa) |
| 53 | EPEVTQTPSHQVTQMGQEVILRCVPISNHLYFWYWRQILGQKVEFLVSFYNNEIS EKSEIFDDQPSVERPDGSNFTLKIRSTKLEDSAMYFCASTTRSSYEQYFGPGTRLT VTEDLKNVFPPEVAVFEPSEAEISHTQKATLVCLATGFYPDHVELSWWVNGKEV HSGVCTDPQPLKEQPALNDSRYCLSSRLRVSATFWQNPRNHFRCQVQFYGLSEN DEWTQDRAKPVTQIVSAEAWGRADCGFTSESYQQGVLSATILYEILLGKATLYA VLVSALVLMAMVKRKDSRG | TCR 6, TCR 12 - Beta Cysteine-modified Homo sapiens (aa) |
| 54 | ATGGATACCTGGCTCGTATGCTGGGTCGCAATTTTAGTCTCTTGAAAGCAGAC TCAACAGAACCTGAAGTCACCCAGACTCCCAGTCCCATCAGGTCACCAGATGGG ACAGGAAGTGATCTTGCGCTGTGTCCCCATCTCAATCACTTATACTTCTATT | TCR 6 - Beta Codon Optimized/Cysteine |

SEQUENCE TABLE-continued

| SEQ ID NO. | SEQUENCE | DESCRIPTION |
|---|---|---|
| | GGTACAGACAAATCTTGGGCAGAAAGTCGAGTTTCTGTTTCTTTTATAA<br>TAATGAAATCTCAGAGAAGTCTGAAATATTCGAATCAATTCTCAGTTGAA<br>AGGCCTGATGATCAAATTTCACTCTGCCAGCACAACGGTCCACAAAGCTGGACTA<br>ACTCAGCCATGTACTTCTGTGCCAGCACAACGGAGGAGCTCCTACGAGCAGTA<br>CTTCGGGCCGGGCACCAGGCTCACGGTCACAGAGGACCTGAAAAACGTGTTC<br>CCACCCGAGTCGCTGTGTTTGAGCCATCAGAAGCAGAGATCTCCCACACCC<br>AAAAGGCCACACTGGTATGCCTGGCCACAGGTCTTACCCCGACCACGTGA<br>GCTGAGCTGTGGTGAATGGGAAGGAGTGCACAGTGGGTCTGCACAGA<br>CCCGCAGCCCTCAAGGAGCAGCCCGCCTCAATGACTCCAGATACTGCCTG<br>AGCAGCCCGCCTGAGGGTCTCGGCACCTTCTGGCAGAACCCCGCAACCACT<br>TCCGCTGTCAAGTCCAGTTCTACGGCTCTCTACGAGAATGACGAGTGGACCCA<br>GGATAGGGCCAAACCTGTCACCCAGATCGTCAGCGCCGAGGCCTGGGTAG<br>AGCAGACTGTGGCTTCACCTCCGAGTCTTACCAGCAAGGGGTCCTGTCTGCC<br>ACCATCCTTCAAGTCCATGAGATCTTGCTAGGGAAGGCCACCTTGTATGCCGTGCTGG<br>TCAGTGCCCTCGTGCTGATGGCCATGGTCAAGAGAAGGATTCCAGAGGC | Modified Homo sapiens (nt) |
| 55 | ATGGATACCTGGCTCGTATGCTGGGCAATTTTAGTCTCTTGAAAGCAGGAC<br>TCACAGAACCTGAAGTCACCCAGCCATCCCAGCAGTCACACAGATGGG<br>ACAGGAGATCTTGCGCTGTCCCCCATCTCAATCACTTATCTTTCTATT<br>GGTACAGACAAATCTTGGGCAGAAAGTCGAGTTTCTGTTTCTTTTATAA<br>TAATGAAATCTCAGAGAAGTCTGAAATATTCGATCAATTCTCAGTTGAA<br>AGGCCTGATGATCAAATTCACTCTGCCAGCACAATCCGGTCCACAAAGCTGGACTA<br>ACTCAGCCATGTACTTCTGTGCCAGCAGTCCTACGAGCAGTAC<br>TTCGGGCCGGGCACCAGGCTCACGGTCACAGAGGACCTGAAAAACGTGTTC<br>CCACCCGAGTCGCTGTGTTTGAGCCATCAGAAGCAGAGATCTCCCACACCC<br>AAAAGGCCACACTGGTATGCCTGGCCACAGGTCTTACCCCGACCACGTGA<br>GCTGAGCTGTGGTGAATGGGAAGGAGTGCACAGTGGGTCTGCACAGA<br>CCCGCAGCCCTCAAGGAGCAGCCCGCCTCAATGACTCCAGATACTGCCTG<br>AGCAGCCCGCCTGAGGGTCTCGGCACCTTCTGGCAGAACCCCGCAACCACT<br>TCCGCTGTCAAGTCCAGTTCTACGGCTCTCTACGAGAATGACGAGTGGACCCA<br>GGATAGGGCCAAACCTGTCACCCAGATCGTCAGCGCCGAGGCCTGGGTAG<br>AGCAGACTGTGGCTTCACCTCCGAGTCTTACCAGCAAGGGGTCCTGTCTGCC<br>ACCATCCTTCAAGTCCATGAGATCTTGCTAGGGAAGGCCACCTTGTATGCCGTGCTGG<br>TCAGTGCCCTCGTGCTGATGGCCATGGTCAAGAGAAGGATTCCAGAGGC | TCR 6 - Beta Native Homo sapiens (nt) |
| 56 | GCGGCCGCCACCATGGATACCTGGCTCGTATGCTGGGCAATTTTTAGTCTCTT<br>GAAAGCAGGACTCACAGAACCTGAAGTCACCCAGCCTCCCAGCCATCAGT<br>CACACAGATGGGACAGGAGATCTTGCGCTGTCGCTGTCCCCATCTCAATCAC<br>TTATACTTCTATTGGTACAGACAAATCTTGGGCAGAAAGTCGAGTTTCTGG<br>TTTCTTTTATAATAATGAAATCTCAGAGAAGTCTGAAATATTCGATGATCAA<br>TTCTCAGTTGAAAGGCCTGATGATCAGCCATGTACTTCTGTGCCAGCAGTCCT<br>CAAGCTGAGGACTTCGGGCCGGGCACCAGGCTCACGGTCACAGAGGACCT<br>GAAAAACGTGTTCCCACCCGAGTCGCTGTGTTTGAGCCATCAGAAGCAGAG<br>ATCTCCCACACCCAAAAGGCCACACTGGTATGCCTGGCCACAGGCTTCTACC<br>CCGACCACGTGGAGCTGAGCTGGTGGTGAATGGGAAGGAGGTGCACAGTG<br>GGGTCTGCACAGACCCGCAGCCCTCAAGGAGCAGCCCGCCCTCAATGACTC<br>CAGATACTGCCTGAGCAGCCGCCTGAGGGTCTCGGCACCTTCTGGCAGAAC<br>CCCGCAACCACTTCCGCTGTCAAGTCCAGTTCTACGGGCTCTCGAGAATG | TCR 6 Codon-optimized/ cysteine-modified full sequence Homo sapiens (nt) |

| SEQ ID NO. | SEQUENCE | DESCRIPTION |
|---|---|---|
| | ACGAGTGGACCCAGATAGGGCCAAACCTGTCACCCAGATCGTCAGCGCCG<br>AGGCCTGGGTAGGACAGACTGTGGCTTCACCTCCGAGTCTTACCAGCAAGG<br>GGTCCTGTCTGCCACCATCCTCTATGAGATCTTGCTAGGAAGGCCACCTTGT<br>ATGCCGTGCTGCTGGTCAGTGCCCTCGTGCTGATGGCCATGGTCAAGAGAAGGA<br>TTCCAGAGGCGGATCCGGAGCTACCAACTTCTCTGCTGAAACAGGCAGGC<br>GATGTGGAGAAAATCCTGGGCAATGAAGACATTTGCTGATTTTCGTTCC<br>TGTTTTTGTGGCTGCAGCTGTATGAGTAGGAGGAGGATGTGGAGCA<br>GAGTCTTTTCCTGAGTGTCCGAGAGGGAGACAGCTCCGTTATAAACTGCACT<br>TACACAGACAGCTCCTCCACCTACTTATACTGGTATAAGCAAGAACCTGAG<br>CAGGTCTCCAGTTGCTGACGTATATTTTTCAAATATGGACATGAAACAAGA<br>CCAAAGACTACTGTTCTATGAATAAAAAGGATAAACATCTGTCTCTGCGC<br>ATTGCAGACACCCAGACTGGGGACTCAGCTATCTACTTCTGTGCAGAGAGTA<br>TAAGAGGCTTTGGAATGTGCTGCATTGCGGGTCCGGCACTCAAGTGATTGT<br>TTTACCCACATATCCAGAACCCTGACCCTGCCGTGTACCAGCTGAGAGACTCT<br>AAATCCAGTGACAAGTCTGTCTGCCTATTCACCGATTTTGATTCTCAAACAAA<br>TGTGTCACAAAGTAAGGATTCTGATGTGTATATCACAGACAAATGTGTGTA<br>GACATGAGGTCTATGGACTTCAAGAGCAACAGTGCTGTGCCTGGAGCAAC<br>AAACCTTCTTCCCCAGCAAAGTTCCTGTGATGTCAAGCTGGTCAGAA<br>AAGCTTTGAAACAGATACGAACCTAAACTTTCAAAACCTGTCAGTGATTGGG<br>TTCCGAATCCTCCTCCTGAAAGTGCCGGGTTTAATCTGCTCATGACGCTGCG<br>GCTGTGGTCTTCCTAAGGCGCGCC | |
| 57 | MDTWLVCWAIFSLLKAGLITEPEVTQTPSHQVTQMGQEVILRCVPISNHLYFYWY<br>RQILGQKVEFLVSFYNNEISEKSEIFDDQFSVERPDGSNFTLKIRSTKLEDSAMYF<br>CASTTRSSYEBQYFGPGTRLTVTEDLKNVFPPEVAVFEPSEAEISHTQKATLVCLA<br>TGFYPDHVELSWWNGKEVHSGVCTDPQPLKEQPALNDSRYCLSSRLRVSATF<br>WQNPRNHFRCQVQFYGLSENDEWTQDRAKPVTQIVSAEAWGRADCGFTSSSY<br>QQGVLSATILYEILLGKATLYAVLVSALVLMAMVKRKDSRGGSGATNFSLLKQ<br>AGDVEENPGPMKTFAGFSFLFLWLQLDCMSRGEDVEQSLFLSVREGDSVINCT<br>YTDSSSTYIYWYKQEPGAGLQLLTYIFSNMDMKQDQRLITVLLNKKDKHLSLRI<br>ADTQTGDSAIYFCAESIRGFGNVLHCGSGTQVIVLPHIQNPDPAVYQLRDSKSSD<br>KSVCLFTDFDSQTNVSQSKDSDVYITDKCVLDMRSMDFKSNSAVAWSNKSDFA<br>CANAFNNSIIPEDTFFPSPESSCDVKLVEKSFETDTNLNFQNLSVIGFRILLLKVAG<br>FNLLMTLRLWSS | TCR 6<br>Full sequence<br>Cysteine-modified<br>Homo sapiens<br>(aa) |
| 58 | KNQVEQSPQSLIILEGKNCTLQCNYTVSPFSNLRWYKQDTGRGPVSLTIMTFSEN<br>TKSNGRYTATLDADTKQSSLHITASQLSDSASYICVVSRDNYGQNFVFGPGTRLS<br>VLPYIQNPDDPAVYQLRDSKSSDKSVCLFTDFDSQTNVSQSKDSDVYITDKTVLD<br>MRSMDFKSNSAVAWSNKSDFACANAFNNSIIPEDTFFPSPESSCDVKLVEKSFET<br>DTNLNFQNLSVIGFRILLLKVAGFNLLMTLRLWSS | TCR 7/ TCR 54<br>(E7)11 - alpha<br>Native<br>Homo sapiens<br>(aa) |
| 59 | KNQVEQSPQSLIILEGKNCTLQCNYTVSPFSNLRWYKQDTGRGPVSLTIMTFSEN<br>TKSNGRYTATLDADTKQSSLHITASQLSDSASYICVVSRDNYGQNFVFGPGTRLS<br>VLPYIQNPDDPAVYQLRDSKSSDKSVCLFTDFDSQTNVSQSKDSDVYITDKCVLD<br>MRSMDFKSNSAVAWSNKSDFACANAFNNSIIPEDTFFPSPESSCDVKLVEKSFET<br>DTNLNFQNLSVIGFRILLLKVAGFNLLMTLRLWSS | TCR 7/ TCR 54<br>(E7)11 - alpha<br>Cysteine-modified<br>Homo sapiens<br>(aa) |

SEQUENCE TABLE-continued

| SEQ ID NO. | SEQUENCE | DESCRIPTION |
|---|---|---|
| 60 | ATGAAAAAGCATCTGACGACCTTCTGGTGATTTTGTGGCTTTATTTTATAG GGGGAATGGCAAAAACCAAGTGGAGCAGAGTCCTCAGTCCCTGATCATCT GGAGGGAAAGAACTGCACTCTTCAATGCAATTATACAGTGAGCCCTTCAGC AACTTAAGGTGGTATAAGCAAGATACTGGGAGAGGTCCTGTTTCCCTGACAA TCATGACTTTCAGTGAGAACACAAAGTGCAAGGAAGATATACAGCAACTCT GGATGCAGACACAAGCTCTCTGCACATACACAGCCTCCCAGCTCAGC GATTCAGCCTCCTACATCTGTGGTGAGCCGGGATAACTATGGTCAGAATT TTGTCTTTTGGTCCCGGAACCAGATTGTCCGTGCTGCCCTTATATCAGACCCCT GACCCCTGCCCGTGTACCAGCTGAGAGACTTAAATCCAGTGACAAGTCTGTCT GCCTATTCACCGATTTTGATTCTCAACAAATGTGTCACAAAGTAAGGATTCT GATGTGTATATCACAGACAAAACTGTCTAGACAATGAGGTCTATGGACTTCA AGACAACAGTGCTGTGGCCTGGAGCAACAAATCTGACTTTGCATGTGCAAA CGCCTTCAACAACAGCATTATTCCAGAAGACACCCTTCTTCCCCAGCCAGAA AGTTCCTGTGATGTCAAGCTGGTCGAGAAAAGCTTTGAAACAGATACGAACC TAAACTTTCAAAACCTGTCAGTGATTGGGTTCCGAATCCTCTCCCTGAAAGTG GCCGGGTTTAATCTGCTCATGACGCTGCGGCTG | TCR 7 - (E7)11 - alpha Native Homo sapiens (nt) |
| 61 | ATGAAGAAACACCTGACCACCTTCCTGGTCATCCTGTGGCTGTACTTCTACA GAGGGAACGGAAAGAATCAGCTGCACTCTGAGTGGAACAGAGTCCACAGTC TGGAGGGCAAAAACTGCACTCTGCAGTGTAATTATACCGTGAGCCCATTTC CAATCTGCGATGGTACAAGCAGGACACTGGACAGGAGCCCGTACTCAGCCACT CATTATGACTTTCTCCGAGAACACAAAGTGCCGCTATACAGCCACTCTGTC CTGGACGCGTGATACTAAAAGTCTAGTCTGCATATCACCCCTCCAGCTGTC TGATAGTGCTTCATATATTTGCGTGGTCAGTAGGGACAACTACGGCAGAAT TTCGTGTTTGGACCAGGAACCCGACTGTCCGTCCTGCCTATATCAGACCCC CGACCCTGCGTGTACCAGCTGAGGGACTTCAAGTCAAGACAGTTCAGGACT TGCCTGTTCACAGACTTTGATTCCCAGACTAATGTGAGCCAGTCCAAGGACT CTGACGTGTACATTACTGACAAATGCCTCTGGAATATGCCAGCATGGACTT TAAGTCTAACAGTGCAGTGCCTGGCCTGTCTAACAAGAGTACTTTCTTTCCATCACCCGA AACGCCTTTAACAATAGTATCATTCCGGAAGATACTTTCTTTCCATCACCCGA GTCCTCTGTGACGTGAAGCTGGTCGAAAAATCATTCGAGACCGATACAAAC CTGAATTTTCAGAACCTGTCTGTGATCGGGTTCCGGATTCTGCTCTGAAGGT CGCCGGATTCAATCTGCTGATGACACTGAGACTGTGGAGTTCA | TCR 7 - (E7)11 - alpha Codon-optimized/ cysteine-modified Homo sapiens (nt) |
| 62 | EPEVTQTPSHQVTQMGQEVILRCVPISNHLYFYWYRQILGQKVEFLVSFYNNEIS EKSEIFDDQFSVERPDGSNFTLKIRSTKLEDSAMYFCAITDRTNYGYTFGSGTRLT VVEDLNKVFPPEVAVFEPSEAEISHTQKATLVCLATGFFPDHVELSWWVNGKEV HSGVSTDPQPLKEQPALNDSRYCLSSRLRVSATFWQNPRNHFRCQVQFYGLSEN DEWTQDRAKPVTQIVSAEAWGRADCGFTSVSYQQGVLSATILYEILLGKATLYA VLVSALIVLMAMVKRKDF | TCR 7/ TCR 54 - (E7)11 -Beta Native Homo sapiens (aa) |
| 63 | EPEVTQTPSHQVTQMGQEVILRCVPISNHLYFYWYRQILGQKVEFLVSFYNNEIS EKSEIFDDQFSVERPDGSNFTLKIRSTKLEDSAMYFCAITDRTNYGYTFGSGTRLT VVEDLNKVFPPEVAVFEPSEAEISHTQKATLVCLATGFFPDHVELSWWVNGKEV HSGVCTDPQPLKEQPALNDSRYCLSSRLRVSATFWQNPRNHFRCQVQFYGLSEN DEWTQDRAKPVTQIVSAEAWGRADCGFTSVSYQQGVLSATILYEILLGKATLYA VLVSALIVLMAMVKRKDF | TCR 7/ TCR 54 - (E7)11 -Beta Cysteine-modified Homo sapiens (aa) |

SEQUENCE TABLE-continued

| SEQ ID NO. | SEQUENCE | DESCRIPTION |
|---|---|---|
| 64 | ATGGATACCTGGCTCGTATGCTGGGCAATTTTAGTCTCTTGAAAGCAGAC TCACAGAACCTGAAGTCACCAGCCATCCAGCCATCAGGTCACCAGATGGG ACAGGAAGTGATCTTGCGCTTGTCCCCATCTCTAATCACTTATATCTTATT GGTACAGACAAATCTGGGGCAGAAAGTCGAGTTTCTGTTTCCTTTATAA TAATGAAATCTGATGGATCAAATTTCACTCTGAAGATCAATTCTCAGTTGAA AGGCCTGATGGATCACATGTCTGAAGATCCGGTCCACAAAGCTGAGG ACTCAGCCATGTACTTCTGTGCCATTACAGCCGACTAACTATGGCTCAC CTTCCGGTTCGGGGACCAGGTTAACCGTTGTAGAGGACCTGAACAAGGTGTTC CCACCCGAGGTCGCTGTGTTTGAGCCATCAGAAGCAGAGATCTCCACACCC AAAAGGCCACACTGTGTGCCTGGCCACAGGTCTTCTCCCTGACCACGTGGA GCTGAGCTGGTGGGTGAATGGGAAGGAGGTGCACAGTGGGTCAGCACGA CCCGCAGCCCTCAAGGAGCAGCCCGCCCTTCAATGACTCCAGATACTGCCTG AGCAGCCGCCTGAGGGTTCTGGCCACCTTCTCGGAGAACCCCGCAACCACT TCCGTTCAAGTCCAGTTCTCACCTGGCTTCTGCAGCCGAGTTGGACCCA GATAGGGCCAAACCCGTCACCCAGATCGTCAGCGCGAGGCCTGGGGTAG AGCAGACTGTGGCTTTACCTCCGTCTCCTACCAGCAAGGGTCCTCTGCC ACCATCCTATGAGATCCTGCTAGGGAAGGCCACCCTGTATGCTGTCCTGG TCAGCGCCCTTGTGTTGATGGCCATGGTCAAGAGAAAGGATTTC | TCR 7 - (E7)11 Beta Native Homo sapiens (nt) |
| 65 | ATGGACACCTGGCTCGTGTCTGGGCAATCTTTAGTCTGCTGAAGGCCGAC TGACCGAGCCTGAAGTGACTCAGCACCCATCCACCAGTGCACCAGATGGG CCAGGAAGTGATCTTGCGGTGCGTCCACCATCTGTACTTCTATT GGTACAGACAGATTCTGGCCAGAGAGGTGAGTTCCAGCTTTTATAA CAACGAGATTCAGAAAGAGCGAGATTTTCACGATCAGTTTCAGTGAA AGAACCCGATGGGAGCAATTTCACCCTGAAGATCAGGAGTCAGCTGGAG CCTTCAGCAGTGTACTTTTGCGCCATTACTGACCGCACAACTATGGATACA CCTTCCGGCTCGGGGACCAGGTGTCTGGAGGACCTGAATAAGGTGTT CCCCCTGAAGTGGCTGTCTTTGAGCCTTCAGGAGGCAGAAATCAGCCACA CAGAAGCCACCCTGGTGTGCCTGGCTACAGGCTTCTTTCCAGATCACGTGG AACTGAGCTGGTGGGTCAACGGCAAGGAGGTGCATTCCGGGGTCTGCACTG ACCCCAGCCCCTGAAAGAGCAGCCCGCTCTTTGAATGATGAGCCAGTATTGCCT GAGCTCCGGCTGAGAGTGTCCGCCACCTTTTGGCAGAACCCTAGGAATCAT TTCCGCTGTCAGGTGCAGTTTTACGGCCTCTGTCTGAAACCACGAGTGGACCC AGGATCGAGCTAAGCTGCTGTACACAGATGTCAGCGCCGAAGCTGTCCGC GCGCAGACTGGCGATTCACCAGCTGTGTCTACCAGCGGTCCTCTGTCCGC CACAATCCTGTATGAGATTCTGCTGGGAAGGCTACTCTGTACGCAGTGCTG GTCTCTGCCTTGGTCGTGATGGCAATGGTCAAGCGGAAAGACTTC | TCR 7 - (E7)11 -Beta Codon-optimized/ cysteine-modified Homo sapiens (nt) |
| 66 | GCCGCCGCCACCATGGACACCTGGCTGGTGTCGTGGCCAATCTTTAGTCTGC TGAAGGCCGACCTGACCGAGCCTGAAGTGACTCAGCACCCATCCACCAGGT CACACAGATGGGCCAGGAAGTGATCCTGCGGTGCGTGCCAATTTCCAACCAT CTGTACTTCTATTGGTATAACAACGAGATCTCAGAAAAGAGCGAGATTTTCGACGATCA GTTTTCAGTGGAAAGACCCCATGAGGAGCAATTTCACCCTGAAGATCAGGAGT ACAAAAACTGGAGATACACCTTCGGCTCGGCCACGACTGACTGTGGTCGAGGACCT GAATAAGGTGTTCCCCCCTGAAGTGGCTGTCTTTGAGCCTTCAGGCAGA AATCAGCCACCACAGAAGCCCACCCTGGTGTGCCTGGCTACAGGCTTCTTC CAGATCACGTGGAACTGAGCTGGTGGGTCAACGGCAAGGAGGTGCATTCCG | TCR 7 - (E7)11 - Codon-optimized/ cysteine-modified full sequence Homo sapiens (nt) |

SEQUENCE TABLE-continued

| SEQ ID NO. | SEQUENCE | DESCRIPTION |
|---|---|---|
| | GGGTCTGCACTGACCACAGCCCCTGAAAGAGAGCAGCCCGCTCTGAATGATAG<br>CAGGTATTGCCTGAGCTGCCCGGCTGCAGTGAGAGTGCCGCCACCTTTGGCAGAAC<br>CCTAGGAATCATTTCGCTCTCAGTGCAGTTTTACGGCCTGTCTGAAAACG<br>ACGAGTGGACCCAGAATGAGCTAAGACCTGTGACACAGATCGTCAGCGCCG<br>AAGCTTGGGGCGCCGCCAGACTGCGATTCACCAGCGTGTCTACCAGCAGG<br>GCGTCCTGTCCGCCACAATCCTGTATGAGATTCTGCTGGGAAGGCTACTCT<br>GTACCAGTCCTGGTCTCTCTGCTGTGATGCAATGGTCAAGCGGAAA<br>GACTTCGGAAGCGGCGCCAACAAACTTTCCCTGCTGAAACAGGCCGAGATG<br>TGGAGGAAATCCTGGCCTACTTCTACAGAGCGAACGGAAAGAATCAGGTGGAACAGAG<br>CCTGTGGCTGTACTTCTACAGAGCGAACGGAAAGAATCAGGTGGAACAGAG<br>TCCACAGTCACTGATCATTCTGGAGGCAAAAACTGCACTCGCAGTGTAAT<br>TATACCGTGAGCCCCATTTTCCAATCTGCGATGGTACAAGCAGGACACTGAC<br>GAGGACCCGTGAGCCTGAGCACTTCTGGATCTCTGGAGAACACCAAGTTAA<br>TGGCCGCTATACAGCCACTCTGGACGCTGATACTAAACAGCTAGTCTGCAT<br>ATCACCGCTCAGCTGTCTGATAGTGCTTCATATATTTGCGTGGTCAGTAG<br>GGACAACTACGGGCAGAATTTCGTGTTTGACCAGGAACCCGACTGTCCGTC<br>CTGCCTTATATCCAGAACCCGACCCTGCCGTGTACCAGCTGAGGGACTCTA<br>AGTCAAGCGGATAAAAGCTGTGCCTGTCTTCACAGACTTTGATTCCAGACTAA<br>TGTGAGCCAGTCCAAGACTCTGACGTGTACATTACTGACAAATGCGTCCTG<br>GATATGCGAGCATGGACTTTAAGTCTAACAGTGCAGTGCCTGTCTAACA<br>AGAGTGATTTCGCTTGCGCAAACGCCTTTAACAATAGTATCATTCCCGAAGA<br>TACTTTCTTTCCATCACCCGAGTCCTTCTTGTGACGTGAAGCTGGTCGAAAAAT<br>CATTCCAGACGAATACAAACCTGAATTTTCAGAACCTGTCTGATCGGGTT<br>CCGGATTCTGCTGCTGAAGGTCGCCGGATTCAATCTGCTGATGACACTGAGA<br>CTGTGGAGTTCATGAGGCGCGCC | |
| 67 | MDTWLVCWAIFSLLKAGLTEPEVTQTPSHQVTQMGQEVILRCVPISNHLYFYWY<br>RQILGQKVEFLVSFYNNEISEKSEIFDDQFSVERPDGSNFTLKIRSTKLEDSAMYF<br>CAITDRTNYGYTFGSGTRLLTVEDLNKVFPPEVAVFEPSEAEISHTQKATLVCLA<br>TGFFPDHVELSWWVNGKEVHSGVCTDPQPLKEQPALNDSRYCLSSRLRVSATF<br>WQNPRNHFRCQVQFYGLSENDEWTQDRAKPVTQIVSAEAWGRADCGFTSVSY<br>QQGVLSATILYEILLGKATLYAVLVSALVLMAMVKRKDFGSGATNFSLLKQAG<br>DVEENPGPMKKHLLTTFLVILMLYFYRGNGKNQVEQSPQSLIILEGKNCTLQCNY<br>TVSPSNLRWYKQDTGRGPVSLTIMTFSENTKSNGRYTATLDADTKQSSLHITAS<br>QLSDSASYICVVSRDNYGQNFVFGPGTRLSVLPYIQNPDPAVYQLRDSKSSDKSV<br>CLFTDFDSQTNVSQSKDSDVYITDKCVLDMRSMDFKSNSAVAWSNKSDFACAN<br>AFNNSIIPEDTFFPSPESSCDVKLVEKSFETDTNLNFQNLSVIGFRILLLKVAGFNL<br>LMTLRLWSS | TCR 7/ TCR 54-(E7)11 -<br>Full sequence<br>Cysteine-modified<br>Homo sapiens<br>(aa) |
| 68 | KQEVTQIPAALSVPEGENLVLNCSFTDSAIYNLQWFRQDPGKGLTSLLLIQSSQR<br>EQTSGRLNASLDKSSGRSTLYIAASQPGDSATYLCAVRPLGNTPLVFGKGTRLSV<br>IANIQNPDPAVYQLRDSKSSDKSVCLFTDFDSQTNVSQSKDSDVYITDKTVLDMR<br>SMDFKSNSAVAWSNKSDFACANAFNNSIIPEDTFFPSPESSCDVKLVEKSFETDT<br>NLNFQNLSVIGFRILLLKVAGFNLLMTLRLWSS | TCR 8 - Alpha<br>Native<br>Homo sapiens<br>(aa) |
| 69 | KQEVTQIPAALSVPEGENLVLNCSFTDSAIYNLQWFRQDPGKGLTSLLLIQSSQR<br>EQTSGRLNASLDKSSGRSTLYIAASQPGDSATYLCAVRPLGNTPLVFGKGTRLSV<br>IANIQNPDPAVYQLRDSKSSDKSVCLFTDFDSQTNVSQSKDSDVYITDKCVLDM | TCR 8 - Alpha<br>Cysteine-modified<br>Homo sapiens |

SEQUENCE TABLE-continued

| SEQ ID NO. | SEQUENCE | DESCRIPTION |
|---|---|---|
|  | RSMDFKSNSAVAWSNKSDFACANAFNNSIIPEDTFFPSPESSCDVKLVEKSFETD TNLNFQNLSVIGFRILLLKVAGFNLLMTLRLWSS | (aa) |
| 70 | ATGGAGACCCTCTTGGGCCTGCTTATCCTTTGGCTGCAGCTGCAATGGGTGA GCAGCAAACAGGAGTGACACAGATTCCTGCAGCTCTGAGTGTCCCAGAAG GAGAAAACTTGGTTCTCAACTGCAGTTTCACTGATAGCGCTATTTACAACCTC CAGTGGTTTAGGCAGGACCCTGGGAAAGGTCTCACATCTCTGTTGCTTATTC AGTCAAGTCAGAGAGGAGCAAACAAGTGGAAGACTTAATGCCTGCTGATA AATCATCAGGACGTAGTACTTTATACATTGCAGCTTCTCAGCCTGGTGACTCA GCCACCTACCTCTGTGCTGTGAGGCCTCTCGGAAACACACCCTTGTCTTTGG AAAGGGCACAGAGACTTTCTGTGATTGCAAATATCCAGAACCCTGACCCTGCC GTGTACCAGCTGAGAGACTCTAAATCCAGTGACAAGTCTGTCTGCCTATTCA CCGATTTTGATTCTCAAACAAATGTGTCACAAAGTAAGGATTCTGATGTGTA TATCACAGACAAAACTGTGCTAGACATGAGGTCTATGGACTTCAAGAGCAAC AGTGCTGTGGCCTGGAGCAACAAATCTGACTTTGCATGTGCAAACGCCTTCA ACAACAGCATTATTCCAGAAGACACCTTCTTCCCAGCCAGATACGAGAGCCTCCCTG TGATGTCAAGCTGTCGTGAGAAGAGCTTTGAAACAGACAAACACACCCTAAACTTT CAAAACCTGTCAGTGATTGGGTTCCGAATCCTCCTCCTGAAAGTGGCCGGGT TTAATCTGCTCATGACGCTGCGGCTC | TCR 8 – Alpha Native Homo sapiens (nt) |
| 71 | ATGGAGACCCTCTTGGGCCTGCTTATCCTTTGGCTGCAGCTGCAATGGGTGA GCAGCAAACAGGAGTGACACAGATTCCTGCAGCTCTGAGTGTCCCAGAAG GAGAAAACTTGGTTCTCAACTGCAGTTTCACTGATAGCGCTATTTACAACCTC CAGTGGTTTAGGCAGGACCCTGGGAAAGGTCTCACATCTCTGTTGCTTATTC AGTCAAGTCAGAGAGGAGCAAACAAGTGGAAGACTTAATGCCTGCTGATA AATCATCAGGACGTAGTACTTTATACATTGCAGCTTCTCAGCCTGGTGACTCA GCCACCTACCTCTGTGCTGTGAGGCCTCTCGGAAACACACCCTTGTCTTTGG AAAGGCACAGAGACTTTCTGTGATTGCAAATATCCAGAACCCTGACCCTGCC GTGTACCAGCTGAGAGACTCTAAATCCAGTGACAAGTCTGTCTGCCTATTCA CCGATTTTGATTCTCAAACAAATGTGTCACAAAGTAAGGATTCTGATGTGTA TATCACAGACAAAATGCGTGCTAGACATGAGGTCTATGGACTTCAAGAGCAAC AGTGCTGTGGCCTGGAGCAACAAATCTGACTTTGCATGTGCAAACGCCTTCA ACAACAGCATTATTCCAGAAGACACCTTCTTCCCAGCCAGATACGAGAGCCTCCCTG TGATGTCAAGCTGTCGTGAGAAGAGCTTTGAAACAGACAAACACACCCTAAACTTT CAAAACCTGTCAGTGATTGGGTTCCGAATCCTCCTCCTGGTCTTCC | TCR 8 – Alpha Codon-optimized/ cysteine-modified Homo sapiens (nt) |
| 72 | KVTQSSRYLVKRTGEKVFLECVQDMDHENMFWYRQDPGLGLRLIYFSYDVKM KEKGDIPEGYSVSREKKERPSLILESASTNQTSMYLCASSLWGASTDTQYFPGT RLTVLEDLKNVFPPEVAVFEPSEAEISHTQKATLVCLATGFYPDHVELSWWVNG KEVHSGVSTDPQPLKEQPALNDSRYCLSSRLRVSATFWQNPRNHFRCQVQFYGL SENDEWTQDRAKPVTQIVSAEAWGRADCGFTSESYQQGVLSATILYEILLGKAT LYAVLVSALVLMAMVKRKDSRG | TCR 8 – Beta Native Homo sapiens (aa) |
| 73 | KVTQSSRYLVKRTGEKVFLECVQDMDHENMFWYRQDPGLGLRLIYFSYDVKM KEKGDIPEGYSVSREKKERPSLILESASTNQTSMYLCASSLWGASTDTQYFPGT RLTVLEDLKNVFPPEVAVFEPSEAEISHTQKATLVCLATGFYPDHVELSWWVNG KEVHSGVCTDPQPLKEQPALNDSRYCLSSRLRVSATFWQNPRNHFRCQVQFYGL | TCR 8 – Beta Cysteine-modified Homo sapiens (aa) |

SEQUENCE TABLE-continued

| SEQ ID NO. | SEQUENCE | DESCRIPTION |
|---|---|---|
| | SENDEMTQDRAKPVTQIVSAEAWGRADCGFTSESYQQGVLSATILYEILLGKAT LYAVLVSALVLMAMVKRKDSRG | |
| 74 | ATGGGAATCAGGCTCCTCTGTGTGTGGCCTTTTGTTTCCTGGCTGTAGGCCT CGTAGATGTGAAAGTAACCCAGAGCTCGAGATATCTAGTCAAAAGGACGGG AGAGAAAGTTTTCTGGAATGTGTCCAGGATGTGACCATGAAAAATATGTTC TGGTATCGACAAGACCCAGGTCTGGGCTACGGCTGATCTATTTCTCATATG ATGTTAAAATGAAAGGAAGGAGCTTCTCCCTGAGTCCGCCAGCACCAACCA GAGAGAAGGAGGAGCGCTTCTGTCCAGCAGTTTATGGGGGGCTAGCACAGATACG CAGTATTTTGGCCACCGGCTGCGTGTTTGAGCCATCAGAAGCAGAGATCTCCA TGTTCCCACCCGAGGTCGCTGTGTTGAGCCTGGCCACACTGTATGCCTGGGTGAATGGAAGGAGGTGCACAGTGGGGTCTGT ACAGACCCGAGCTGGTGGGTGAATGGAAGGAGCAGCCCCTCAATGACTCCAGATACT GCCTGAGCAGCGCCCTGAAGTCCAGTTCTACGGCTCTCGGAGAATGACGAGTGG ACCCAGGATAGGGCCAAACTGTCACCTCCGAGTCTTACCAGCAAGGCCTGT GGTAGAGCAGACTGTGGCTTCACCTCCGAGTCTTACCAGCAAGGGGTCTGT CTGCCACCATCCTCTATGAGATCTTGCTAGGGAAGGCCACCTTGTATGCCGT GCTGGTCAGTGCCCTCGTGCTGATGGCCATGGTCAAGAGAAAGGATTCCAGA GGC | TCR 8 - Beta Native Homo sapiens (nt) |
| 75 | ATGGGAATCAGGCTCCTCTGTGTGTGGCCTTTTGTTTCCTGGCTGTAGGCCT CGTAGATGTGAAAGTAACCCAGAGCTCGAGATATCTAGTCAAAAGGACGGG AGAGAAAGTTTTCTGGAATGTGTCCAGGATGTGACCATGAAAAATATGTTC TGGTATCGACAAGACCCAGGTCTGGGCTACGGCTGATCTATTTCTCATATG ATGTTAAAATGAAAGGAAGGAGCTTCTCCCTGAGTCCGCCAGCACCAACCA GAGAGAAGGAGGAGCGCTTCTGTCCAGCAGTTTATGGGGGGCTAGCACAGATACG CAGTATTTTGGCCACCGGCTGCGTGTTTGAGCCATCAGAAGCAGAGATCTCCA TGTTCCCACCCGAGGTCGCTGTGTTGAGCCTGGCCACACTGTATGCCTGACCAC CACCCAAAAGGCCACACTGTGGGTGAATGGAAGGAGGTGCACAGTGGGGTCTGT ACAGACCCGAGCTGGTGGGTGAATGGAAGGAGCAGCCCCTCAATGACTCCAGATACT GCCTGAGCAGCGCCCTGAAGTCCAGTTCTACGGCTCTCGGAGAACCCCGCAA ACCCAGGATAGGGCCAAACTGTCACCTCCGAGTCTTACCAGCAAGGCCTGT GGTAGAGCAGACTGTGGCTTCACCTCCGAGTCTTACCAGCAAGGGGTCTGT CTGCCACCATCCTCTATGAGATCTTGCTAGGGAAGGCCACCTTGTATGCCGT GCTGGTCAGTGCCCTCGTGCTGATGGCCATGGTCAAGAGAAAGGATTCCAGA GGC | TCR 8 - Beta Codon-optimized/ cysteine-modified Homo sapiens (nt) |
| 76 | GCGGCCGCCACCATGGGAATCAGGCTCCTCTGTCTGTGGCCTTTTGTTTCCT GGCTGTAGGCCTCGTAGATGTGAAAGTAACCCAGAGCTCGAGATATCTAGTC AAAAGGACGGGAGAGAAAGTTTTCTGGAATGTGTCCAGGATGTGACCAT GAAAAATATGTTCTGGTATCGTGACAAGACCCAGGTCTGGGCTACGGCTGATCT ATTTCTCATATGATGTTAAAATGAAAGAAAAGGAGATATTCCTGAGGGTA CAGTGTCTCTAGAGAAGAAGGAGCGCTTCTCCCTGATTCTGAGTGCCGCC | TCR 8 Codon-optimized/ cysteine-modified full sequence Homo sapiens (nt) |

SEQUENCE TABLE-continued

| SEQ ID NO. | SEQUENCE | DESCRIPTION |
|---|---|---|
| | AGCACCAACCAGACATCTATGTGCCTCTGTGCCAGCAGTTTATGGGGGCTA GCACAGATACGCAGTATTTGGCCACCCAGGACTGACAGTGCTCAGGA CCTGAAAAACGTGTTCCCACCCGAGTCGCTGTTTGAGCCATCAGAAGCA GAGATCTCCCACACCCAAAAGGCCACACTGGTATGCCTGGCCACAGGCTTCT ACCCCGACCACGTGGAGCTGAGCTGGTGGGTAATGGGAGGAGTGCACA GTGGGGTCTGTACAGACCCAGCAGCCCCTCAAGGAGCAGCCCCTCAATGA CTCCAGATACTGCCTGAGCAGCCGCCTCAGGGTCTCGGCCACCTTCTGGCAG AACCCCGACCACCACTTCCGCTGTCAAGTCCAGTTCTACGGGCTCTCGGAGA ATGACGAGTGGACCCAGGATAGGGCCAAACCTGTCACCCAGATCGTCAGCG CCGAGGCCTGGGGTAGAGCAGACTGTGGCTTCACCTCCGAGTCTTACCAGCA AGGGGTCCTCTCTGCCACCATCCTCTATGAGATCTCTGTAGGAAGGCCACC TTGTATGCCCGTGCTGGTCAGTGCCCTCGTCTGATGGCCATGGTCAAGAGAA AGGATTCCAGAGGCGGATCCGAGCTACCAACTTCTCTCTGCTGAAGAGGC AGGCCGATGTGGAGAAAATCTGGGCCAGCTGGAGACCCTCTTGGCCCTGCTT ATCCTTGTCGCAGTGGCTGAGCAGCACACAGCAGGAGGTGACACAG ATTCCTGCAGCTCTGAGTGTCCCAGAAGGAGAAAACTTGGTTCTCAACTGCA GTTCACTGATAGCGCTATTTACAACCTCCAGTGGTTTAGGCAGGACCCTGG GAAAGGTCTCACATCTCTGTTGCTTATTCAGTCAGTCAAGACTCAGAGACAA AGTGCAGATAATGCCTCGCTGATAAATCATCAGAACTCAGTAGTACTTTAT ACATTGCAGTTCTCAGCCTGGACTCAGCCACCTACTCCTGTGTGTGAGG CCTCTCGGAAACACACACCTCTGTCTTTGAAAGGGCACAAGACTTTCTGTGA TTGCAAATATCCAGAACCCTGACCCTGCCGTGTACCAGCTGAGAGACTCTAA ATCCAGTGACAAGTCTGTCTGCCTATTCACCGATTTTGATTCTCAAACAAATG TGTCACAAATGTAAGGATTCTGATGTGTATATCACAGACAAATGCGTCTAGA CATGAGGTCTATGACTTCAAGAGCAACAGTGCTGTGGCCTGGAGCAACAA ATCTGACTTTGCATGCAAACGCCTTCAACAACCATTATTCCAGAAGAC ACCTTCTCCCCAGCCAGAAAGTTCCTGATGTCAAGCTGGTCGAGAAAA GCTTTGAACAGATACGAACCTAACTTCTGAAACCTGTCAGTGATTGGGTT CCGAATCCCTCCTCTCCTGAAAGTGGCCGGGGTTTAATCTGCATGACGCTGCGG CTCTGGTCTTCCTAAGGCGCGCC | |
| 77 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLILESASTNQTSM YLCASSLWGASTDTQYFGPGTRLTVLEDLKNVFPPEVAVFEPSEAEISHTQKATL VCLATGFYPDHVELSWWVNGKEVHSGVCTDPQPLKEQPALNDSRYCLSSRLRV SATFWQNPRNHFRCQVQFYGLSENDEWTQDRAKPVTQIVSAEAWGRADCGFTS ESYQQGVLSATILYEILLGKATLYAVLVSALVLMAMVKRKDSRGGSGATNFSLL KQAGDVEENPGPMETLLGLLILWLQLQWVSSKQEVTQIPAALSVPEGENLVLNC SFTDSAIYNLQWFRQDPGKGLTSLLLIQSSQREQTSGRLNASLDKSSGRSTLYIAA SQPGDSATYLCAVRPLGNTPLVFGKGTRLSVIANIQNPDPAVYQLRDSKSSDKSV CLFTDFDSQTNVSQSKDSDVYITDKCVLDMRSMDFKSNSAVAWSNKSDFACAN AFNNSIIPEDTFFPSPESSCDVKLVEKSFETDTNLNFQNLSVIGFRILLLKVAGFNL LMTLRLMSS | TCR 8 Full sequence Cysteine-modified Homo sapiens (aa) |
| 78 | AQKITQTQPGMFVQEKEAVTLDCTYDTSDPSYGLFWYKQPSSGEMIFLIYQGSY DQQNATEGRYSLNFQKARKSANLVISASQLGDSAMYFCAMRTAGGTSYGKLTF GQGTILTVHPNIQNPDPAVYQLRDSKSSDKSVCLFTDFDSQTNVSQSKDSDVYIT DKTVLDMRSMDFKSNSAVAWSNKSDFACANAFNNSIIPEDTFFPSPESSCDVKL VEKSFETDTNLNFQNLSVIGFRILLLKVAGFNLLMTLRLMSS | TCR 9 - Alpha Native Homo sapiens (aa) |

SEQUENCE TABLE-continued

| SEQ ID NO. | SEQUENCE | DESCRIPTION |
|---|---|---|
| 79 | AQKITQTQPGMFVQEKEAVTLDCTYDTSDPSYGLFWYKQPSSGEMIFLIYQGSY DQQNATEGRYSLNFQKARKSANLVISASQLGDSAMYFCAMRTAGTSYGKLTF GQGTILTVHPNIQNPDPAVYQLRDSKSSDKSVCLFTDFDSQTNVSQSKDSDVYIT DKCVLDMRSMDFKSNSAVAWSNKSDFACANAFNNSIIPEDTFFPSPESSCDVKL VEKSFETDTNLNFQNLSVIGFRILLLKVAGFNLLMTLRLWSS | TCR 9 - Alpha Cysteine-modified Homo sapiens (aa) |
| 80 | ATGTCACTTTCTAGCCTGCTGAAGGTGGTCACAGCTTCACTGTGGCTAGGAC CTGGCATTGCCCAGAAGATAACTCAAACCCAACCAGGAATGTTCGTGCAGGA AAAGGAGGCTGTGACTCTGGACTGCACATATGACACCAGTGATCCAAGTTAT GGTCTATTCTGGTACAAGCAGCCCAGCAGTGGGGAAATGATTTTCTTATTTA TCAGGGGTCTTATGACCAGCAAATGCAACAGAAGGTCGCTAACTGCACAACTGG TTCCAGAAGGCAAGAAAATCCGCCAACCTTGTCATCTCCGCTTCACAACTGG GGGACTCAGCAATGTACTTCTGTGCAATGAGAACTGCTGGTGGTACTAGCTA TGGAAAGCTGACATTTGGACAAGGACCATCTTGACTGTCCATCCAAATATC CAGAACCCTGACCCTGCCGTGTACCAGCTGAGAGACTCTAAATCCAGTGACA AGTCTGTCTGCCTATTCACCGATTTTGATTCTCAAACAAATGTGTCACAAAGT AAGGATTCTGATGTGTATATCACAGACAAATGTGTCTAGACATGAGGTCTA TGGACTTCAAGAGCAACAGTGCTGTGGCCTGGAGCAACAAATCTGACTTTGC ATGTGCAAACGCCTTCAACAACAGCATTATTCCAGAAGACACCTTCTTCCCC AGCCCAGAAAGTTCCTGTGATGTCAAGCTGGTCGAGAAAAGCTTTGAAACAG ATACGAACCTAAACTTTCAAAACCTGTCAGTGATTGGGTTCCGAATCCTCCTC CTGAAAGTGGCCGGGTTTAATCTGCTCATGACGCTGCGGCTG | TCR 9 - Alpha Native Homo sapiens (nt) |
| 81 | ATGTCACTTTCTAGCCTGCTGAAGGTGGTCACAGCTTCACTGTGGCTAGGAC CTGGCATTGCCCAGAAGATAACTCAAACCCAACCAGGAATGTTCGTGCAGGA AAAGGAGGCTGTGACTCTGGACTGCACATATGACACCAGTGATCCAAGTTAT GGTCTATTCTGGTACAAGCAGCCCAGCAGTGGGGAAATGATTTTCTTATTTA TCAGGGGTCTTATGACCAGCAAATGCAACAGAAGGTCGCTAACTGCACAACTGG TTCCAGAAGGCAAGAAAATCCGCCAACCTTGTCATCTCCGCTTCACAACTGG GGGACTCAGCAATGTACTTCTGTGCAATGAGAACTGCTGGTGGTACTAGCTA TGGAAAGCTGACATTTGGACAAGGACCATCTTGACTGTCCATCCAAATATC CAGAACCCTGACCCTGCCGTGTACCAGCTGAGAGACTCTAAATCCAGTGACA AGTCTGTCTGCCTATTCACCGATTTTGATTCTCAAACAAATGTGTCACAAAGT AAGGATTCTGATGTGTATATCACAGACAAATGTGTCTAGACATGAGGTCTA TGGACTTCAAGAGCAACAGTGCTGTGGCCTGGAGCAACAAATCTGACTTTGC ATGTGCAAACGCCTTCAACAACAGCATTATTCCAGAAGACACCTTCTTCCCC AGCCCAGAAAGTTCCTGTGATGTCAAGCTGGTCGAGAAAAGCTTTGAAACAG ATACGAACCTAAACTTTCAAAACCTGTCAGTGATTGGGTTCCGAATCCTCCTC CTGAAAGTGGCCGGGTTTAATCTGCTCATGACGCTGCGGCTGTGTCTTCC | TCR 9 - Alpha Codon-optimized/ cysteine-modified Homo sapiens (nt) |
| 82 | NAGVTQTPKFRVLKTGQSMTLLCAQDMNHEYMYWYRQDPGMGLRLIHYSVGE GTTAKGEVPDGYNVSRLKKQNFLLGLESAAPSQTSVYFCASSYFGTAYEQYFGP GTRLTVTEDLKNVFPPEVAVFEPSEAEISHTQKATLVCLATGFYPDHVELSWWV NGKEVHSGVSTDPQPLKEQPALNDSRYCLSSRLRVSATFWQNPRNHFRCQVQFY GLSENDEWTQDRAKPVTQIVSAEAWGRADCGFTSESYQQGVLSATILYEILLGK ATLYAVLVSALVLMAMVKRKDSRG | TCR 9 - Beta Native Homo sapiens (aa) |

SEQUENCE TABLE-continued

| SEQ ID NO. | SEQUENCE | DESCRIPTION |
|---|---|---|
| 83 | NAGVTQTPKPRVLKTGQSMTLLCAQDMNHEYMYWYRQDPGMGLRLIHYSVGE GTTAKGEVPDGYNVSRLKKQNFLLGLESAAPSQTSVYFCASSYFGTAYEQYFGP GTRLTVTEDLKNVFPPEVAVFEPSEAEISHTQKATLVCLATGFYPDHVELSWWV NGKEVHSGVCTDPQPLKEQPALNDSRYCLSSRLRVSATFWQNPRNHFRCQVQF YGLSENDEWTQDRAKPVTQIVSAEAWGRADCGFTSESYQQGVLSATILYEILLG KATLYAVLVSALVLMAMVKRKDSRG | TCR 9 - Beta Cysteine-modified Homo sapiens (aa) |
| 84 | ATGAGCCTCGGGCTCCTGTGCTGTGGGCCTTTCTCTCCTGTGGCAGTCC AGTGAATGCTGGTGTCACTCAGACCCCAAAATTCCGGGTCCTGAAGACAGGA CAGAGCATGACACTGCTGTGTGCCCAGGATATGAACCATGAATACATGTACT GGTATCGACAAGACCCAGGCATGGGCTGAGGCTGATTCATTACTCAGTTGG TGAGGGTACAACTGCCAAAGGAGAGGTCCCTGATGGCTACAATGTCTCCAGA TTAAAAAACAGAATTTCCTGCTGGGTTTGGAGTCGGCTGCACCTCCCCAAA CATCTGTGTACTTCTGTGCCAGCAGTTACTTCGGGACAGCCTACGAGCAGTA CTTCGGGCCGGGCACCAGGCTCACGGTCACAGAGGACCTGAAAAACGTGTTC CCACCCGAGTCTGCTGTGTTTGAGCCATCAGAAGCAGAGATCTCCCACACCC AAAAGGCCACACTGGTCTGCCTGGCCACAGGGTTCTACCCCGACCACGTGGA GCTGAGCTGTGGGTGAATGGGAAGGAGGTGCACAGTGGGGTCAGCACAGA CCCGCAGCCCCTCAAGGAGCAGCCCGCCCTCAATGACTCGGGTCTGTACGA AGCAGCCGCCTCAAGTCCAGTTCACCCTCAGAACCCCCGCCCAACCACT TCCGCTCGTCAAGTCAGTCTCACCCCAGATCGTCAGCGCCGAGGGCCTGGGGTAG GAATAGGGCCAAACCTGTCACCTTCACCCTCAGCCGTCGAGTGGACCCA ACCATCCTTATGAGATCTTGCTAGGGAAGGCCACCCTTGTATGCCTGTCTGG TCAGTGCCCTCGTGCTGATGGCCATGGTCAAGAGAAAGGATTCCAGAGGC | TCR 9 - Beta Native Homo sapiens (nt) |
| 85 | ATGAGCCTCGGGCTCCTGTGCTGTGGGCCTTTCTCTCCTGTGGCAGTCC AGTGAATGCTGGTGTCACTCAGACCCCAAAATTCCGGGTCCTGAAGACAGGA CAGAGCATGACACTGCTGTGTGCCCAGGATATGAACCATGAATACATGTACT GGTATCGACAAGACCCAGGCATGGGCTGAGGCTGATTCATTACTCAGTTGG TGAGGGTACAACTGCCAAAGGAGAGGTCCCTGATGGCTACAATGTCTCCAGA TTAAAAAACAGAATTTCCTGCTGGGTTTGGAGTCGGCTGCACCTCCCCAAA CATCTGTGTACTTCTGTGCCAGCAGTTACTTCGGGACAGCCTACGAGCAGTA CTTCGGGCCGGGCACCAGGCTCACGGTCACAGAGGACCTGAAAAACGTGTTC CCACCCGAGTCTGCTGTGTTTGAGCCATCAGAAGCAGAGATCTCCCACACCC AAAAGGCCACACTGGTCTGCCTGGCCACAGGGTTCTACCCCGACCACGTGGA GCTGAGCTGTGGGTGAATGGGAAGGAGGTGCACAGTGGGGTCTGTACGA CCCGCAGCCCCTCAAGGAGCAGCCCGCCCTCAATGACTCGGGTCTGTACGA AGCAGCCGCCTCAAGTCCAGTTCACCCTCAGAACCCCCGCCAACCACT TCCGCTCGTCAAGTCAGTTCACCCTCAGATGACGAGTGGACCCA GGATAGGGCCAAACCTGTCACCCAGATCGTCAGCGCCGAGGGCCTGGGGTAG ACCATCCTTATGAGATCTTGCTAGGGAAGGCCACCTTGTATGCCTGTCTGG TCAGTGCCCTCGTGCTGATGGCCATGGTCAAGAGAAAGGATTCCAGAGGC | TCR 9 - Beta Codon-optimized/ cysteine-modified Homo sapiens (nt) |
| 86 | GCGGCCGCCGCCATGAGCCTCGTGCTGTGTGGGCCTTTTCTCTCCTT GTGGGCAGGTCCAGTGAATGCTGGTGTCACTCAGACCCCAAAATTCCGGGTC CTGAAGACAGGACAGAGCATGACACTGCTGTGTGCCCAGGATATGAACCAT | TCR 9 - Codon-optimized/ cysteine-modified full |

SEQUENCE TABLE-continued

| SEQ ID NO. | SEQUENCE | DESCRIPTION |
|---|---|---|
| | GAATACATGTACTGTGTATCGACAAGACCCAGGCATGGGCTGAGGCTGATTC<br>ATTACTCAGTTGGTGAGGGTACAACTGGCCAAAGGAGGAGGTCCCTGATGGCTA<br>CAATGTCTCCAGATTAAAAAAACAGAATTCCTGCTGGGAGTCGGCT<br>GCTCCCTCCCAAACATCTGTACTTCTGTGCCAGCAGTTACTTCGGGACAGC<br>CTACGAGCAGTACTTCGGGCCGGGCCACCAGGCTCACGGTCACAGAGGACCT<br>GAAAAACGTGTTCCCACCCGAGGTCGTGTGTTTGAGCCATCAGAAGCAGAG<br>ATCTCCAAACCTGGAAAGGCCACACTGGTGTGCCTGGCCACAGGCTTCTACC<br>CCGACCACGTGGAGCTGAGCTGGTGGTGAATGGGAAGAGGTGCACAGTG<br>GGGTCTGTACAGACCCGACCAGCCCTCAAGGAGCAGCCCGCCTCAATGACTC<br>CAGATACTGCCTGAGCAGCCGCCTGAGGGTCTCGGCCACCTTCTGGCAGAAC<br>CCCCGCAACCACTTCCGCTGTCAAGTCCAGTTCTACGGGCTCTGAGAATG<br>ACGAGTGGACCCAGGATAGGGCCAAACCTGTCACCCAGATCGTCAGCGCCG<br>AGGCCTGGGGTAGAGCAGACTGTGCTTCACCTCCGAGTCTTACCAGCAAGG<br>GGTCCTGTCTGCCACCATCCTCTATGAGATCTTGCTAGGGAAGGCCACCTTGT<br>ATGCCGTGCTGGTCAGTCCGTCTGTGCTGATGGCCATGGTCAAGAGAAAGGA<br>TTCCAGAGGCGGATCCGAGCTACCAACTTCTCTCTGCTGAAACAGGCAGGC<br>GATGTGGAGGAAAATCCTGGGCCTAGGACCTGGCATTGCCAGAAGATAACTCAAAC<br>TCAACAGGAGTGTTCGTGCAGAAAGGAGGCTGTGACTCTGACTGCAC<br>ATATGACACCAGTGATCCAAGTTATGGTCTATTCTGGTACAAGCAGCCCAGC<br>AGTGGGGAAATGATTTTCTATTTATCAGGGGTCTTATGCCAGCAGCAAAATG<br>ACCTTGCTACCTCATTCCGACACTTGGACCTCAGCAATGTACTTCTGTGCA<br>ACCTTGCTCATCTCCGCTTCCACACCGGGGACTCCAGCAATGTACTTCTGTGCA<br>ATGAGAACTGCTGGTGGTACTAGCTATGGAAAGCTGACATTTGGACAAGGG<br>ACCATCTTGACTGTCATCCAAATATCCAGAACCTGACCCCTGCCGTGTACC<br>AGTGGAGAGACTCTAAATCCAGTGACAAGTCTGTCTGCCTATTCACCGATTTT<br>GATTCTCAAACAAATGTCATCAGGTAAGGATTCACAGATTTCAAAAGGCCTAGTGAT<br>ACAATGTGTCTAGACATGAGCTATGAGCTTCAAGAGACAAGCTGCTGT<br>GGCCTGGAGCAACAAATCTGACTTTGCATGTCAAACGCCTTCAACACAGC<br>ATTATTCCAGAAGACACCTTCTTCCCCAGCCAGAAAGTTCCTGTGATGTCA<br>AGCTGGTCGAGAAAGCTTTGAAACAGATACGAACCTAAACTTTCAAAACCT<br>GTCAGTGATTGGGTTCCGAATCCTCCTCTGAAAGTGGCCGGGTTTAATCTGC<br>TCATGACGCTTGCGGCTGTGGTCTTCCTAAGGCGCGCC | sequence<br>Homo sapiens<br>(nt) |
| 87 | MSLGLLCCGAFSLLWAGPVNAGVTQTPKFRVLKTGQSMTLLCAQDMNHEYMY<br>WYRQDPGMGLRLIHYSVGEGTTAKGEVPDGYNVSRLKKQNFLLGLESAAPSQT<br>SVYFCASSYPGTAYBQYFGPGTRLTVTEDLKNVFPPEVAVFEPSEAEISHTQKAT<br>LVCLATGFYPDHVELSWWNGKEVHSGVCTDPQPLKEQPALNDSRYCLSSRLR<br>VSATFWQNPRNHFRCQVQFYGLSENDEWTQDRAKPVTQIVSAEAWGRADCGF<br>TSESYQQGVLSATILYEILLGKATLYAVLVSALVLMAMVKRKDSRGGSGATNFS<br>LLKQAGDVEENPGPMSLSSLLKVVTASLMLGPGIAQKITQTQPGMFVQEKEAVT<br>LDCTYDTSDPSYGLFWYKQPSSGEMIFLIYQGSVDQQNATEGRYSLNFQKARKS<br>ANLVISASQLGDSAMYFCAMRTAGGTSYGKLTFGQGTILTVHPNIQNPDPAVYQ<br>LRDSKSSDKSVCLFTDFDSQTNVSQSKDSDVYITDKCVLDMRSMDFKSNSAVA<br>WSNKSDFACANAFNNSIIPEDTFFPSPESSCDVKLVEKSFETDTNLNFQNLSVIGF<br>RILLLKVAGFNLLMTLRLWSS | TCR 9 -<br>Full sequence<br>Cysteine-modified<br>Homo sapiens<br>(aa) |
| 88 | RKEVEQDPGPFNVPEGATVAFNCTYSNSASQSFFWYRQDCRKEPKLLMSVYSSG<br>NEDGRFTAQLNRASQYISLLIRDSKLSDSATYLCVNFPSRGAGTSYGKLTFGQ | TCR 10 - Alpha<br>Native |

SEQUENCE TABLE-continued

| SEQ ID NO. | SEQUENCE | DESCRIPTION |
|---|---|---|
| | GTILTVHPNIQKPDDPAVYQLRDSKSSDKSVCLFTDFDSQTNVSQSKDSDVYITDK TVLDMRSMDFKSNSAVAWSNKSDFACANAFNNSIIPADTFFPSPESSCDVKLVE KSFETDTNLNFQNLSVIGFRILLLKVAGFNLLMTLRLWSS | Homo sapiens (aa) |
| 89 | RKEVEQDPGPFNVPEGATVAFNCTYSNSASQSFFWYRQDCRKEPKLLMSVYSSG NEDGRFTAQLNRASQYISLLIRDSKLSDSATYLCVVNFPSRGAGTSYGKLTFGQ GTILTVHPNIQKPDDPAVYQLRDSKSSDKSVCLFTDFDSQTNVSQSKDSDVYITDK CVLDMRSMDFKSNSAVAWSNKSDFACANAFNNSIIPADTFFPSPESSCDVKLVE KSFETDTNLNFQNLSVIGFRILLLKVAGFNLLMTLRLWSS | TCR 10 - Alpha Cysteine-modified Homo sapiens (aa) |
| 90 | ATGATGATATCCTTGAGAGTTTACTGGTGATCCTGTGGCTTCAGTTAAGCTG GGTTTGGAGCCAACGGAAGGAGGTGGAGCAGGATCCTGGACCCTTCAATGTT CCAGAGGGAGCCACTGTCGCTTTCAACTGTACTTACAGCAACAGTGCTTCTC AGTCTTTCTTCTGGTACAGACAGGATTGCAGGAAAGAACCTAAGTGCTGAT GTCCGTATACTCCAGTGGTAATGAAGATGGAAGGTTTACAGCACAGCTCAAT AGAGCCAGCCAGTATATTTCCCTGCTCATCAGAGACTCCAAGCTCAGTGATT CAGCCACCTACCTCTGTGTGGTGAACTTCCCTTCTCGGGGTGCTGGTACTT AGCTATGGAAAGCTGACATTTGGACAAGGACCATCTTGACTGTCCATCCAA ATATCCAGAGGCCTGACCCTGCCGTGTACCAGCTGAGAGACTCTAAATCCAG TGACAAGTCTGTCTGCCTATTCACCGATTTTGATTCTCAAACAAATGTGTCAC AAAGTAAGGATTCTGATGTGTATATCACAGACAAAACTGTGCTAGACATGAG GTCTATGGACTTCAAGAGCAACAGTGCTGTGGCTTGGAGCAACAAATCTGAC TTTGCATGCGCAAACGCCTTCAACAACAGCATTATTCCAGCAGACACCTTCTT CCCCAGCCCAGAAAGTTCCTGTGATGTCAAGCTGGTCGAGAAAAGCTTTGAA ACAGATACGAACCTAAACTTCAAAACCTGTCTGATTGGTTCCGAATCC TCCTCCTGAAAGTGGCCGGGTTTAATCTGCTCATGACGCTGCGGCTGTGGTCT | TCR 10 - Alpha Native Homo sapiens (nt) |
| 91 | ATGATGATATCCTTGAGAGTTTACTGGTGATCCTGTGGCTTCAGTTAAGCTG GGTTTGGAGCCAACGGAAGGAGGTGGAGCAGGATCCTGGACCCTTCAATGTT CCAGAGGGAGCCACTGTCGCTTTCAACTGTACTTACAGCAACAGTGCTTCTC AGTCTTTCTTCTGGTACAGACAGGATTGCAGGAAAGAACCTAAGTGCTGAT GTCCGTATACTCCAGTGGTAATGAAGATGGAAGGTTTACAGCACAGCTCAAT AGAGCCAGCCAGTATATTTCCCTGCTCATCAGAGACTCCAAGCTCAGTGATT CAGCCACCTACCTCTGTGTGGTGAACTTCCCTTCTCGGGGTGCTGGTACTT AGCTATGGAAAGCTGACATTTGGACAAGGACCATCTTGACTGTCCATCCAA ATATCCAGAGGCCTGACCCTGCCGTGTACCAGCTGAGAGACTCTAAATCCAG TGACAAGTCTGTCTGCCTATTCACCGATTTTGATTCTCAAACAAATGTGTCAC AAAGTAAGGATTCTGATGTGTATATCACAGACAAAACTGTGCTAGACATGAG GTCTATGGACTTCAAGAGCAACAGTGCTGTGGCTTGGAGCAACAAATCTGAC TTTGCATGCGCAAACGCCTTCAACAACAGCATTATTCCAGCAGACACCTTCTT CCCCAGCCCAGAAAGTTCCTGTGATGTCAAGCTGGTCGAGAAAAGCTTTGAA ACAGATACGAACCTAAACTTCAAAACCTGTCTGATTGGTTCCGAATCC TCCTCCTGAAAGTGGCCGGGTTTAATCTGCTCATGACGCTGCGGCTGTGGTCT TCC | TCR 10 - Alpha Codon-optimized/ cysteine-modified Homo sapiens (nt) |
| 92 | DVKVTQSSRYLVKRTGEKVFLECVQDMDHENMFWYRQDPGLGLRLIYFSYDV KMKEKGDIPEGYSVSREKKERFSLILESASTNQTSMYLCASSLSLTGNYGYTFGS GTRLTVEDLNKVFPPEVAVFEPSEAEISHTQKATLVCLATGFPPDHVELSWWV NGKEVHSGVSTDPQPLKEQPALNDSRYCLSSRLRVSATFWQNPRNHFRCQVQFY | TCR 10 - Beta Native Homo sapiens (aa) |

| SEQ ID NO. | SEQUENCE | DESCRIPTION |
|---|---|---|
| | GLSENDEWTQDRAKPVTQIVSAEAWGRADCGFTSVSYQQGVLSATILYEILLGK ATLYAVLVSALVLMAMVKRKDF | |
| 93 | DVKVTQSSRYLVKRTGEKVFLECVQDMDHENMFWYRQDPGLGLRLIYFSYDV KMKEKGDIPEGYSVSREKKERFSLILESASTNQTSMYLCASSLSLTGNYGYTFGS GTRLTVVEDLNKVFPPEVAVFEPSEAEISHTQKATLVCLATGFFPDHVELSWWV NGKEVHSGVCTDPQPLKEQPALNDSRYCLSRLRVSATFWQNPRNHFRCQVQF YGLSENDEWTQDRAKPVTQIVSAEAWGRADCGFTSVSYQQGVLSATILYEILLG KATLYAVLVSALVLMAMVKRKDF | TCR 10 – Beta Cysteine-modified Homo sapiens (aa) |
| 94 | ATGGGAATCAGGCTCCTCTGTGTGGCCTTTTGTTTCTGGCTGTAGGCCT CGTAGATGTGAAAGTAACCCAGAGCTCGAGATATCTAGTCAAAAGGACGGG AGAGAAAGTTTTTCTGGAATGTGTCCAGGATATGGACCATGAAAATATGTTC TGGTATCGACAAGACCCAGGTCTGGGGCTACGGCTGATCTATTTCTCATATG ATGTTAAAATGAAAGAAAAAGGAGATATTCCTGAGGGGTACAGTGTCTCTA GAGAGAAGAAGGAGCGCTTCTCCCTGATTCTGGAGTCCGCCAGCACCAACCA GACATCTATGTACCTCTGTGCCAGCAGTTTATCCCTAACAGGGAACTATGGC TGTTCCACCCGAGTCGCTGTGTTTGAGCCATCAGAAGCAGAGATCTCCCA CACCCAAAAGGCCACACTGGTGTGCCTGGCCACAGGCTTCTTCCCTGACCAC GTGGAGCTGAGCTGGTGGGTGAATGGGAAGGAGGTGCACAGTGGGTCAGC ACGACCCCAGCCCCTCAAGGAGCAGCCCGCCCTCAATGACTCCAGATACT GCCTGAGCAGCCGCCTGAGGGTCTCGGCCACCTTCTGGCAGAACCCCCGCAA CCACTTCCGTTGTCAAGTCCAGTTCTACGGGCTCTCGGAGAATGACGAGTGG ACCCAGGATAGGGCCAAACCCGTCACCCAGATCGTCAGCGCCGAGGCCTGG GGTAGAGCAGACTGTGGCTTTACCTCGGTGTCCTACCAGCAAGGGGTCCTGT CTGCCACCATCCTCTATGAGATCCTGCTAGGGAAGGCCACCCTGTATGCTGT GCTGGTCAGCGCCCTTGTGTTGATGGCCATGGTCAAGAGAAAGGATTTC | TCR 10 – Beta Native Homo sapiens (nt) |
| 95 | ATGGGAATCAGGCTCCTCTGTGTGGCCTTTTGTTTCTGGCTGTAGGCCT CGTAGATGTGAAAGTAACCCAGAGCTCGAGATATCTAGTCAAAAGGACGGG AGAGAAAGTTTTTCTGGAATGTGTCCAGGATATGGACCATGAAAATATGTTC TGGTATCGACAAGACCCAGGTCTGGGGCTACGGCTGATCTATTTCTCATATG ATGTTAAAATGAAAGAAGGAGATATTCCTGAGGGGTACAGTGTCTCTA GAGAGAAGAAGGAGCGCTTCTCCCTGATTCTGGAGTCCGCCAGCACCAACCA GACATCTATGTACCTCTGTGCCAGCAGTTTATCCCTAACAGGGAACTATGGC TACACCTTCGGTTCGGGGACCAGGTTAACCGTTGTAGAGGACCTGAACAAGG TGTTCCCACCCGAGTCGCTGTGTTTGAGCCATCAGAAGCAGAGATCTCCCA CACCCAAAAGGCCACACTGGTGTGCCTGGCCACAGGCTTCTTCCCTGACCAC GTGGAGCTGAGCTGGTGGGTGAATGGGAAGGAGGTGCACAGTGGGTCTGT ACGGACCAGCCCGCCAGCCCCTCAAGGAGCAGCCCGCCCTCAATGACTCCAGATACT GCCTGAGCAGCCGCCTGAGGGTCTCGGCCACCTTCTGGCAGAACCCCCGCAA CCACTTCCGTTGTCAAGTCCAGTTCTACGGGCTCTCGGAGAATGACGAGTGG ACCCAGGATAGGGCCAAACCCGTCACCCAGATCGTCAGCGCCGAGGCCTGG GGTAGAGCAGACTGTGGCTTTACCTCGGTGTCCTACCAGCAAGGGGTCCTGT CTGCCACCATCCTCTATGAGATCCTGCTAGGGAAGGCCACCCTGTATGCTGT GCTGGTCAGCGCCCTTGTGTTGATGGCCATGGTCAAGAGAAAGGATTTC | TCR 10 – Beta Codon-optimized/ cysteine-modified Homo sapiens (nt) |

SEQUENCE TABLE-continued

| SEQ ID NO. | SEQUENCE | DESCRIPTION |
|---|---|---|
| 96 | GCGGCCGCCACCATGGGAATCAGGCTCCTCTGTCTGTGCCTTTGTTCCT GGCTGTAGGCCTCGTAGAGTGAAAGTAACCAGAGCTCCAGAGATCTAGTC AAAAGGACGGAGAGAAAGTTTTCTGCAATGTGCCAGGACCAT GAAAATATGTTCTGTATCGACAAGACCCAGGTCTGGGCTACGCTGATCT ATTTCTCATATGATGTTAAAATGAAAGAAAAGGAGATATTCCTGAGGGTA CAGTGTCTCTAGAGAAGAAGAGGAGCTTCTCCCTAGAGGTCCTGAGGGTA AGCACCAACCAGACATCTATGTACCTCTGTGCCAGCAGTTTATCCCTAACAG GGAACTATGCTACACCTTCGGTTCGGGACCAGGTTAACCGTGTAGAGGA CCTGAACAAGGTGTTCCCACCCGAGGTCGCTGTGTTTGAGCCATCAGAAGCA GAGATCTCCCACACCCAAAAGGCCACACTGGTGTGCCTGGCCACAGGCTTCT TCCCTGACCACGTGGAGCTGAGCTGGTGGGTGAATGGGAAGGAGGTGCACA GTGGGGTCTGTACGGACCCGAGCAGCCCGCTGAGGGGTCTCGGCCACCTTCTGGCAG CTCCAGATACTGCCACTTCGCGTCAAGTCCAGTTCTACGGGCTCTGGAGA AACCCCAACCACTTCGCTGTCAAGTCCAGTTCTACGGGCTCTGGAGA ATGACGAGTGACCCAGGATAGGGCCAAACCCGTCACCCAGATCGTCAGCG CCGAGGCCTGGGGTAGAGACAGTGGCTTTACCTCGGTGTCTACCAGCA AGGGGTCCTGTCTGCCACCATCCTATGAGATCCTGCTAGGGAAGGCCACC CTGTATGCTGTCAGCGCCCTCTGTTGTGAGACTGGCCATGGTCAAGAGAA AGGATTTCGGATCCGAGCTACCAACTTCTCTCTGCTGAAACAGGCAGGCGA TGTGGAGGAAAATCCTGGCCAATGCTGGGTTTGAGCCAACGAAGGAGGTGAGC ATCCTGTGGCTTCAGTTAAGCTGCTTCAATGTTCCAGAGGGAGCCACTCGT GCCTTGTCGCTTTCAACTG AGGATCCTGGGGCTTCAATGTTCCAGAGGGAGCCACTGTCGCTTTCAACTGC CTTCTGGGGTCTGGTGGTACTAGCTATCAGAAGCGTGACATTTGACAAGG GACCATCTTGACTGTCCATCAAATATCCAGAAGCCTGCCTATTCACCGATT CAGCTGAGAGACTTAAATCCAGTGACAAGTCGTCGCTGCTATTCACCGATT TTGATTCTCAAACAAATGTGCAAGTAAGGATCTGATGTGTATATCAC AGACAAATGTGCTAGAGACAGGTCTATGGACTTCAAGACAACAGTGCT GTGGCCTGAGCAACAAATCTGACTTTCATGTGCAAACCCTTCAACACA GCATTATTCCAGCAGCACACCTTCTTCCCCAGCCAGAAGTTCTGTGATGTC AAGCTGGTCAGCTGATTGGGTTCCAATCCTCTCCTGAAAGTGCCGGGTTTAATCT GCTCATGACCGCTGCCGCTGTGCTTCTTCCTAAGGCGCGCC | TCR 10 Codon-optimized/ cysteine-modified full sequence Homo sapiens (nt) |
| 97 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLILESASTNQTSM YLCASSLSLITGNYGYTFGSGTRLTVVEDLNKVFPPEVAVFEPSEAEISHTQKATL VCLATGFFPDHVELSWWVNGKEVHSGVCTDPQPLKEQPALNDSRYCLSSRLRV SATFWQNPRNHFRCQVQFYGLSENDEWTQDRAKPVTQIVSAEAWGRADCGFTS VSYQQGVLSATILYEILLGKATLYAVLVSALVLMAMVKRKDFGSSATNFSLLKQ AGDVEENPGPMMISLRVLLVILWLQLSWVWSQRKEVEQDPGPFNVPEGATVAF NCTYSNSASQSFFWYRQDCRKEPKLLMSVVSSGNEDGRFTAQLNRASQYISLLIR DSKLSDSAATYLCVVNFPSRGAGGTSYGKLTFGQGTILTVHPNIQKPDPAVYQLR DSKSSDKSVCLFTDFDSQTNVSQSKDSDVYITDKCVLDMRSMDFKSNSAVAWS | TCR 10 Full sequence Cysteine-modified Homo sapiens (aa) |

SEQUENCE TABLE-continued

| SEQ ID NO. | SEQUENCE | DESCRIPTION |
|---|---|---|
| | NKSDFACANAFNNSIIPADTFFPSPESSCDVKLVEKSFETDTNLNFQNLSVIGFRIL LLKVAGFNLLMTLRLWSS | |
| 98 | DAKTTQPNSMESNEEEPVHLPCNHSTISGTDYIHWYRQLPSQGPEYVIHGLTSNV NNRMASLAIAEDRKSSTLILHRATLRDAAVYYCILSAHSNSGYALNFGKGTSLLV TPHIQNPDPAVYQLRDSKSSDKSVCLFTDFDSQTNVSQSKDSDVYITDKTVLDM RSMDFKSNSAVAWSNKSDFACANAFNNSIIPEDTFFPSPSSCDVKLVEKSFETD TNLNFQNLSVIGFRILLLKVAGFNLLMTLRLWSS | TCR 11 - Alpha Native Homo sapiens (aa) |
| 99 | DAKTTQPNSMESNEEEPVHLPCNHSTISGTDYIHWYRQLPSQGPEYVIHGLTSNV NNRMASLAIAEDRKSSTLILHRATLRDAAVYYCILSAHSNSGYALNFGKGTSLLV TPHIQNPDPAVYQLRDSKSSDKSVCLFTDFDSQTNVSQSKDSDVYITDKCVLDM RSMDFKSNSAVAWSNKSDFACANAFNNSIIPEDTFFPSPSSCDVKLVEKSFETD TNLNFQNLSVIGFRILLLKVAGFNLLMTLRLWSS | TCR 11 - Alpha Cysteine-modified Homo sapiens (aa) |
| 100 | ATGAAGTTGGTGACAAGCATTACTGTACTCCTATCTTTGGGTATTATGGGTGA TGCTAAGACCACACAGCCCAAATTCAATGAGAGTAACGAAGAAGAGCCTGT TCACTTGCCTTGTAACCACTCCACAATCAGTGGAACTGATTACATACATTGGT ATCGACAGCTTCCCCCAGGGTCCAGAGTACGTGATTCATGGTCTTACAAG CAATGTGAACAACAGAATGGCCTCTCTGCAATCGCTGAAGACAGAAGTC CAGTACCTTGAGCGCTCACCTGTACCTTTGAGAGATGCTACTCAACTTCGGCTCGTTGG GCATCCTGAGCGCTCACTCAAATTCCGGGTATGCACTCAACTTCGGCAAGG CACCTCGCTGTTGTCACACCCCATATCCAGAACCCTGCACCCTGCCGTACC AGCTGAGAGACTCTAAATCCAGTGACAAGTCTGTCTGCCTATTCACCGATTTT GATTCTCAAACAAATGTCACAAGTAAGGATTCTGATGTGTATATCACAG ACAAAACTGTGCTAGACATGAGGTCTATGGACTTCAAGAGCAACAGTGCTGT GGCCTGGAGCAACAAATCTGACTTTGCATGTGCAAACGCCTTCAACAGC ATTATTCCAGAAGACACCTTCTTCCCCAGCCCAGAAGTTCCTGTGATGCA AGCTGGTCGAGAAAAGCTTTGAAACAGATACGAACCTAAACTTTCAAAACCT GTCAGTGATTGGGTTCCGAATCCTCCTGAAAGTGGCCGGGTTTAATCTGC TCATGACGCTGCGGCTG | TCR 11 - Alpha Native Homo sapiens (nt) |
| 101 | ATGAAGTTGGTGACAAGCATTACTGTACTCCTATCTTTGGGTATTATGGGTGA TGCTAAGACCACACAGCCCAAATTCAATGAGAGTAACGAAGAAGAGCCTGT TCACTTGCCTTGTAACCACTCCACAATCAGTGGAACTGATTACATACATTGGT ATCGACAGCTTCCCCCAGGGTCCAGAGTACGTGATTCATGGTCTTACAAG CAATGTGAACAACAGAATGGCCTCTCTGCAATCGCTGAAGACAGAAGTC CAGTACCTTGAGCGCTCACCTGTACCTTTGAGAGATGCTACTCAACTTCGGCTCGTTGG GCATCCTGAGCGCTCACTCAAATTCCGGGTATGCACTCAACTTCGGCAAGG CACCTCGCTGTTGTCACACCCCATATCCAGAACCCTGCACCCTGCCGTACC AGCTGAGAGACTCTAAATCCAGTGACAAGTCTGTCTGCCTATTCACCGATTTT GATTCTCAAACAAATGTCACAAGTAAGGATTCTGATGTGTATATCACAG ACAAAACTGTGCTAGACATGAGGTCTATGGACTTCAAGAGCAACAGTGCTGT GGCCTGGAGCAACAAATCTGACTTTGCATGTGCAAACGCCTTCAACAGC ATTATTCCAGAAGACACCTTCTTCCCCAGCCCAGAAGTTCCTGTGATGCA AGCTGGTCGAGAAAAGCTTTGAAACAGATACGAACCTAAACTTTCAAAACCT GTCAGTGATTGGGTTCCGAATCCTCCTGAAAGTGGCCGGGTTTAATCTGC TCATGACGCTGCGGCTGTGGTCTTCC | TCR 11 - Alpha Codon-optimized/ cysteine-modified Homo sapiens (nt) |

SEQUENCE TABLE-continued

| SEQ ID NO. | SEQUENCE | DESCRIPTION |
|---|---|---|
| 102 | SAVISQKPSRDICQRGTSLTIQCQVDSQVTMMFWYRQQPGQSLTLIATANQGSEA TYESGFVIDKFPISRPNLTFSTLTVSNMSPEDSSIYLCSVVPWTRGGSTDTQYFGP GTRLTVLEDLKNVFPPEVAVFEPSEAEISHTQKATLVCLATGFYPDHVELSWWV NGKEVHSGVSTDPQPLKEQPALNDSRYCLSSRLRVSATFWQNPRNHFRCQVQFY GLSENDEWTQDRAKPVTQIVSAEAWGRADCGFTSESYQQGVLSATILYEILLGK ATLYAVLVSALVLMAMVKRKDSRG | TCR 11 - Beta Native Homo sapiens (aa) |
| 103 | SAVISQKPSRDICQRGTSLTIQCQVDSQVTMMFWYRQQPGQSLTLIATANQGSEA TYESGFVIDKFPISRPNLTFSTLTVSNMSPEDSSIYLCSVVPWTRGGSTDTQYFGP GTRLTVLEDLKNVFPPEVAVFEPSEAEISHTQKATLVCLATGFYPDHVELSWWV NGKEVHSGVCTDPQPLKEQPALNDSRYCLSSRLRVSATFWQNPRNHFRCQVQF YGLSENDEWTQDRAKPVTQIVSAEAWGRADCGFTSESYQQGVLSATILYEILLG KATLYAVLVSALVLMAMVKRKDSRG | TCR 11 - Beta Cysteine-modified Homo sapiens (aa) |
| 104 | ATGCTGAGTCTTCTGCTCCTTCTCCTGGGACTAGGCTCTGTGTTCAGTGCTGT CATCTCTCAAAAGCCAAGCAGGGATATCTGTCAACGTGGAACCTCCCTGACG ATCCAGTGTCAAGTCGATAGCCAAGTCACCATGATGTTCTGGTACCGTCAGC AACCTGGACAGAGAGTCGATTTGTCATTGACAACAGTTTCCCATCAGCCGCCAAA CCACATATGAGAGTGGATTTGTCATTGACAAGTTTCCCATCAGCCGCCAAA CCTAACACTCTCAACTCTGACTGTGTCAATGAGCAACATGAGCCCTGAAGACAGCAGC ATATATCTCTGCAGCGTTCTGCCCTTGGACGCGCGGGGAGACAGTGCTGAAGACCTGAAAAACGT GTTCCCACCCGAGGTCGCTGTGTTTGAACCATCAGAAGCAGAGATCTCCCAC ACCCAAAAGGCCACACTGGTGTGCCTGGCCACAGGCTTCTACCCCGACCACG TGGAGCTGAGCTGGTGGGTGAATGGGAAGGAGGTGCACAGTGGGGTCAGCA CAGACCCGCAGCCCTGCCCCTCAAGGAGCAGCCCGCTCAATGACTCCAGATACTG CCTGAGCAGCAGGCTTCTGGCCACACTTCTGGCAGAAGGCCACCTTGTATGCCGTG CACTTCCGCTGTCAAGTCCAGTTCTACGGGCTGTCTGAGAATGACGAGTGA CCCAGGATAGGGCCAAACCTGTCACCCCAGATCGTCAGCGCCGAGGCCTGGG GTAGAGCAGACTGTGCTTCAGCCTCCGAGTTCTTACCAGCAAGGCCAAGGGGTCCTGTC CCTGAGCACCATCCTCTATGAGATCTTGCTAGGGAAGGCCACCTTGTATGCCGTG CACTTCCGCTGTCAAGTCCAGTTCTACGGGCTGTCTGAGAATGACGAGTGA CCCAGGATAGGGCCAAACCTGTCACCCCAGATCGTCAGCGCCGAGGCCTGG GC | TCR 11 - Beta Native Homo sapiens (nt) |
| 105 | ATGCTGAGTCTTCTGCTCCTTCTCCTGGGACTAGGCTCTGTGTTCAGTGCTGT CATCTCTCAAAAGCCAAGCAGGGATATCTGTCAACGTGGAACCTCCCTGACG ATCCAGTGTCAAGTCGATAGCCAAGTCACCATGATGTTCTGGTACCGTCAGC AACCTGGACAGAGCCTGACACTGATTGCAATTGCAAATCAGGGCTCTGAGG CCACATATGAGAGTGGATTTGTCATTGACAAGTTTCCCATCAGCCGCCCAAA CCTAACACTCTCAACTCTGACTGTGTCAATGAGCAACATGAGCCCTGAAGACAGCAGC ATATATCTCTGCAGCGTTGTCCCTTGGACGCAGTGCTGAAGACCAGAGATCTCCCAC ACCCAAAAGGCCACACTGGTCTGTTTGAGCCATCAGAAGCAGAGATCTCCCAC ACCCAAAAGGCCACACTGGTGTGCCTGGCCACAGGCTTCTACCCCGACCACG TGGAGCTGAGCTGGTGGGTGAATGGAAGGAGCCCCTCAATGACTCCAGATACTG CAGACCCGCAGCCCGCTCAAGGAGCAGCCCGCACCTTCTGGCAGAACCCCGCAAC CCTGAGCAGCCGCTGCGCTCAAGGAGCAGCCCGCACCTTCTGGCAGAACCCCGCAAC CACTTCCGCTGTCAAGTCCAGTTCTACGGCCTCTTCGGAGAATGACGAGTGGA CCCAGGATAGGGCCAAACCTGTCACCCAGATCGTCAGCGCCGAGGCCTGGG | TCR 11 - Beta Codon-optimized/ cysteine-modified Homo sapiens (nt) |

SEQUENCE TABLE-continued

| SEQ ID NO. | SEQUENCE | DESCRIPTION |
|---|---|---|
| | GTAGAGCAGACTGTGGCTTCACCTCCGAGTCTTACCAGCAAGGGGTCCTGTC TGCCACCATCCTCTATGAGATCTTGCTAGGGAAGGCCACCTTGTATGCCGTG CTGGTCAGTGCCCTGCTGTCGATGGCCATGGTCAAGAGGAAGGATTCCAGAG GC | |
| 106 | GCGGCCGCCACCATGCTGAGTCTTCTCCTCCTTCTCCTGGGACTAGGCTCTGT GTTCAGTGCTGTCATCTCTCAAAAGCCAAGCAGGGATATCTGTCAACGTGA ACCTCCCTGACGATCCAGTGCAAGTCGATAGCCAAGTCACCATGATGTTCT GGTACCGTCAGCAACCTGGACAGAGCCTGACACTGATCGCAACTGCAAATCA GGGCTCTGAGGCCACATATGAGAGTGGATTTGTCATTGACAAGTTTCCCATC AGCCGCCCAAACCTAACATTCTCAACTCTGATCTGTGACAACATGAGCCCTG AAGACAGCAGCATATATCTCTGCAGCGTGTCCCTTGACGCGCGGGGGAG CACAGATACGCAGTATTTTGCCCACCGAGTGCGTGTGTTTGAGCCATCAGAAGCAG CTGAAAAACGTGTTCCCACCCAAAAGGCCACACTGTGTGCCAAGGCTTCTA AGATCTCCCAACCCACCACTTCCGCTGTCAAGTCACACTGTGCCTGGCCATGGA CCCGACCACTGGAGCTGAGCTGTGGGTGAATGGGAAGGAGTGCACAG TGGGGTCTGTACAGACCCGCAGCCCTGAGGAGCAGCCCCTCAATGAC TCCAGATACTGCCTGAGCAGCCGTCTCGGCCACCTTCTGGCAGA ACCCCCGCAACCACTTCCGCTGTCAAGTCCAGTTCTACGGGCTCTCGAGAA TGACGAGTGGACCCAGGATAGGGCCAAACCTGTCACCCAGATCGTCAGCGC CGAGGCCTGGGGTAGAGCAGACTGTGGCTTCACCTCCGAGTCTTACCAGCAA GGGGTCCTGTCTGCCACCATCCTCTATGAGATCTTGCTAGGGAAGGCCACCT TGTATGCCGTGCTGGTCCCTGCTGTCAGTGCCCATGGCCATGGTCAAGAAA GGATTCCAGAGGCCGGATCCGAGCTACCAACTTCTCTGCTGAACAGCA GGCGATGTGGAGGAAAATCCGGCCAATGAAGTTGGTGACAAGCATTACT GTACTCCTATCTTTGGGTATTATGGGTGATGCTAAGACACAGCCAAATT CAATGCAGGTAAGCAAGGAAGAGACCGTTCACTTGCCTTGTAACCACTCCAC AATCAGTGGAACTGATTACATACATTGGTATCGACAGCTTCCCTCCAGGGT CCAGAGTACGTGATTCATGCTCTTACAAGCAATGTGAACAAGAGAATGGCCT CTCTGCAATGCTGAAGACAGAAGTCCAGTACCTTGATCCTGCACCGTGC TACCTTGAGAGATGCTGCTGTACTACTGCATCCTGAGCGCTCACTCAAATT CCGGCTATGCACTTCAACTTCGGCAACGCACCTCCGTGTTGGTCACACCCA TATCCAGAACCCTGACCCTGCCGTGTACCCAGCGTGAGAGACTCTAAATCCAGT GACAAGTCTGTCTGCCTATTCACCGATTTTGATTCTCAAACAAATGTGTCACA AAGTAAGGATTCAAGACAACAACGTGTGCCTGAGCAACAAATCTGACT TCTATGCATGTCAAGAGAATATCCAACACAGCATTATTCCAGAAGACACCCTTCTT CCCCAGCCCAGAAGTTCCTGTGATGTCAAGCTGTCAAGAAAAGCTTTGAA ACAGATACGAACCTAAACTTTCAAAACCTGTCAGTGATTGGGTTCCGAATCC TCCTCCTGAAAGTGCCGGGTTTAATCTGCTCATGACGCGTGCGGCTGTGTCT TCCTAAGGCGCC | TCR 11 Codon-optimized/ cysteine-modified full sequence Homo sapiens (nt) |
| 107 | MLSLLLLLLGLGSVFSAVISQKPSRDICQRGTSLTIQCQVDSQVTMMFWYRQQP GQSLTLIATANQGSEATYESGFVIDKFPISRPNLTFSTLTVSNMSPEDSSIYLCSVV PWTRGGSTDIQYFGPGTRLTVLEDLKNVFPPEVAVFEPSEAEISHTQKATLVCLA TGFYPDHVELSWWNGKEVHSGVCTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVSALVLMAMVKRKDSRGGSGATNFSLLKQ AGDVEENPGPMKLVTSITVLLSLGIMGDAKTTQPNSMESNEEEPVHLPCNHSTIS | TCR 11 Full sequence Cysteine-modified Homo sapiens (aa) |

SEQUENCE TABLE-continued

| SEQ ID NO. | SEQUENCE | DESCRIPTION |
|---|---|---|
|  | GTDYIHWYRQLPSQGPEYVIHGLTSNVNNRMASLAIAEDRKSSTLIHRATLRDA AVYYCILSAHSNSGYALNFGKGTSLLVTPHIQNPDPAVYQLRDSKSSDKSVCLFT DFDSQTNVSQSKDSDVYITDKCVLDMRSMDFKSNSAVAWSNKSDFACANAFNN SIIPEDTFFPSPESSCDVKLVEKSFETDTNLNFQNLSVIGFRILLLKVAGFNLLMTL RLWSS |  |
| 108 | ATGGATACCTGGCTCGTATCCTGGGCAATTTTAGTCTCTTGAAAGCAGAC TCACAGAACCTGAAGTCACCCAGACTCCCAGCCATCACCAGATGGG ACAGGAAGTGATCTTGCGCTGTCCCCATCTCTAATCACTTATACTTCTATT GGTACAGACAAATCTTGGGGCAGAAAGTCGAGTTTCTGGTTTCCTTTATAA TAATGAAATCAGAGAAGTCAGAAATATTCGATGATCAATTCTCAGTTGAA AGGCCTGATGGATCAAATTTCACTCTGAAGATCCGTCCACAAAGCTGAGG ACTCAGCCATGTACTTCTGTGCCAGCACAACGAGGAGCTCCTACGAGCAGTA CTTCCGGGCCGGGCACCCAGGTCACGGTCACAGAGGACCTGAAAAACGTGTTC CCACCCGAGGTCGCTGTGTTGAGCCATCAGAAGCAGAGATCTCCACACCC AAAAGCCACACTGGTTGTGGAAGGAGGTGCACAGTGGGGTCAGACAGA GCTGAGCTGTGGGTGAATGGAGAGCAGCCCGCCCTCAATGACTCCAGATACTGCCTG CCCGCAGCCCTCAAGGAGCAGCCCCTTCTGGCAGAACCCCGCAACCACT TCCGCTGTCAGTCCTTCTACACGGCTCTCGGAGAATGACGAGTGGACCCA GGATAGGGCCAAACCTGTCACCTCCCAGATCGTCAGCGCCGAGGCCTGGGGTAG AGCAGACTGTGGCTTCACCTCCGAGTCTTACCAGCAAGGGTCTCTGTCTCC ACCATCCTCTATGAGATCTTGCTAGGGAAGGCCACCTTGTATGCCGTCTGG TCAGTGCCCTGCTGTCTGATGCCATGGTCAAGAGAAAGGATTCCAGAGGCTA G | TCR 12 - Beta Native Homo sapiens (nt) |
| 109 | DLRNVTPPKVSLFEPSKAEIANKQKATLVCLARGFFPDHVELSWWVNGKEVHS GVSTDPQAYKESNYSYCLSSRLRVSATFWINPRNHFRCQVFQFHGLSEEDKWPE GSPKPVTQNISAEAWGRADCGITSASYHQGVLSATILYEILLGKATLYAVLVSGL VLMAMVKRKNS | Mouse beta constant sequence Mus musculus (aa) |
| 110 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLILESASTNQTSM YLCASSLWGASTDTQYFGPGTRLTVLEDLKNVFPPEVAVFEPSEAEISHTQKATL VCLATGFYPDHVELSWWVNGKEVHSGVSTDPQPLKEQPALNDSRYCLSSRLRV SATFWQNPRNHFRCQVFQFYGLSENDEWTQDRAKPVTQIVSAEAWGRADCGFTS ESYQQGVLSATILYEILLGKATLYAVLVSALVLMAMVKRKDSRG | TCR 8 - Beta Native Homo sapiens (aa) |
| 111 | AQKITQTQPGMFVQEKEAVTLDCTYDTSDQSYGLFWYKQPSSGEMIFLIYQGSY DEQNATEGRYSLNFQKARKSANLVISASQLGDSAMYFCAMREGRGFKTIFGAGT RLFVKA | TCR 3 alpha variable region Homo sapiens (aa) |
| 112 | GAGVSQSPRYKVAKRGQDVALRCDPISGHVSLFWYQQALGQGPEFLTYFQNEA QLDKSGLPSDRFFAERPEGSVSTLKIQRTQQEDSAVYLCASSHLAGFTGELFFGE GSRLTVL | TCR 3 beta variable region Homo sapiens (aa) |

SEQUENCE TABLE-continued

| SEQ ID NO. | SEQUENCE | DESCRIPTION |
|---|---|---|
| 113 | DAKTQPNSMESNEEPVHLPCNHSTISGTDYIHWYRQLPSQGPEYVIHGLTSNV NNRMASLAIAEDRKSSTLIIHRATLRDAAVYYCILLVIRGTSYGKLTFGQGTILT VHP | TCR 4 - (E6)29 alpha variable region Homo sapiens (aa) |
| 114 | GVSQDPRHKITKRGQNVTFRCDPISEHNRLYWYRQTLGQGPEFLTYFQNEAQLE KSRLLSDRFSAERPKGSFSTLEIQRTEQGDSAMYLCASSPGGNTEAFFGQGTRL TVV | TCR 4 - (E6)29 Beta variable region Homo sapiens (aa) |
| 115 | AQKITQTQPGMFVQKEAVTLDCTYDTDSQSYGLFWYKQPSSGEMIFLIYQGSY DEQNATEGRYSLNFQKARKSANLVISASQLGDSAMYFCAMREGTGTSYGKLTF GQGTILTVHP | TCR 5 - (E6)29 - TCR alpha variable region Homo sapiens (aa) |
| 116 | KVTQSSRYLVKRTGEKVFLECVQDMDHENMFWYRQDPGLGLRLIYFSYDVKM KEKGDIPEGYSVSREKKERFSLILESASTNQTSMYLCASSPWGETHQPQHFGDGT RLSIL | TCR 5 - (E6)29 - TCR beta variable region Homo sapiens (aa) |
| 117 | GEDVEQSLFLSVREGDSSVINCTYTDSSSTYLYWYKQEPGAGLQLLTYIFSNMD MKQDQRLTVLLNKKDKHLSLRIADTQTGDSAIYFCAESIRGFGNVLHCGSGTQV IVLP | TCR 6 alpha variable region Homo sapiens (aa) |
| 118 | EPEVTQTPSHQVTQMGQEVILRCVPISNHLYFYWYRQILGQKVEFLVSFYNNEIS EKSEIFDDQFSVERPDGSNFTLKIRSTKLEDSAMYFCASTTRSSYEQYFGPGTRLT VT | TCR 6, TCR 12 Beta variable region Homo sapiens (aa) |
| 119 | KNQVEQSPQSLIILEGKNCTLQCNYTVSPSNLRWYKQDTGRGPVSLTIMTFSEN TKSNGRYTATLDADTKQSSLHITASQLSDSASYICVVSRDNYGQNFVFGPGTRLS VLP | TCR 7/ TCR 54 - (E7)11 - alpha variable region Homo sapiens (aa) |
| 120 | EPEVTQTPSHQVTQMGQEVILRCVPISNHLYFYWYRQILGQKVEFLVSFYNNEIS EKSEIFDDQFSVERPDGSNFTLKIRSTKLEDSAMYFCAITDRTNYGYTFGSGTRLT VV | TCR 7/ TCR 54- (E7)11 -Beta variable region Homo sapiens (aa) |
| 121 | KQEVTQIPAALSVPEGENLVLNCSFTDSAIYNLQWFRQDPGKGLTSLLLIQSSQR EQTSGRLNASLDKSSGRSTLYIAASQPGDSATYLCAVRPLGNTPLVFGKTRLSV IA | TCR 8 alpha variable region Homo sapiens (aa) |

SEQUENCE TABLE-continued

| SEQ ID NO. | SEQUENCE | DESCRIPTION |
|---|---|---|
| 122 | KVTQSSRYLVKRTGEKVFLECVQDMDHENMFWYRQDPGLGLRLIYFSYDVKM KEKGDIPEGYSVSREKKERFSLILESASTNQTSMYLCASSLWGASTDTQYFGPGT RLITVL | TCR 8 Beta variable region Homo sapiens (aa) |
| 123 | AQKITQTQPGMFVQEKEAVTLDCTYDTSDPSYGLFWYKQPSSGEMIFLIYQGSY DQQNATEGRYSLNFQKARKSANLVISASQLGDSAMYFCAMRTAGGTSYGKLTF GQGTILTVHP | TCR 9 alpha variable region Homo sapiens (aa) |
| 124 | NAGVTQTPKFRVLKTGQSMTLLCAQDMNHEYMYWYRQDPCMGLRLIIHYSVGE GTTAKGEVPDGYNVSRLKKQNFLLGLESAAPSQTSVYFCASSYFGTAYEQYFGP GTRLTVT | TCR 9 Beta variable region Homo sapiens (aa) |
| 125 | RKEVEQDPGPNVPEGATVAFNCTYSNSASQSFFWYRQDCRKEPKLLMSVYSSG NEDGRFTAQLNRASQYISLLIRDSKLSDSATYLCVVNFPSRGAGGTSYGKLTFGQ GTILTVHP | TCR 10 alpha variable region Homo sapiens (aa) |
| 126 | KVTQSSRYLVKRTGEKVFLECVQDMDHENMFWYRQDPGLGLRLIYFSYDVKM KEKGDIPEGYSVSREKKERFSLILESASTNQTSMYLCASSLLTGNYGYTFGSGTR LTVV | TCR 10 Beta variable region Homo sapiens (aa) |
| 127 | DAKTTQPNSMESNEEEPVHLPCNHSTISGTDYIHWYRQLPSQGPEYVIHGLTSNV NNRMASLAIAEDRKSSTLIIHRATLRDAAVYYCILSAHSNSGYALNFGKGTSLLV TP | TCR 11 alpha variable region Homo sapiens (aa) |
| 128 | SAVISQKPSRDICQRGTSLTIQCQVDSQVTMMFWYRQQPGQSLTLIATANQGSEA TYESGFVIDKFPISRPNLITFSTLTVSNMSPEDSSIYLCSVVPWTRGGSTDTQYFGP GTRLTVL | TCR 11 Beta variable region Homo sapiens (aa) |
| 129 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLILESASTNQTSM YLCASSLWGASTDTQYFGPGTRLTVLEDLKNVFPPEVAVFEPSEAEISHTQKATL VCLATGFYPDHVELSWWVNGKEVHSGVCTDPQPLKEQPALNDSRYCLSSRLRV SATFWQNPRNHFRCQVQFYGLSENDEWTQDRAKPVTQIVSAEAWGRADCGFTS ESYQQGVLSATILYEILLGKATLYAVLVSALVLMAMVKRKDSRG | TCR 8 - Beta Cysteine-modified Homo sapiens (aa) |
| 130 | MSLSSLLKVTASLWLGPGIAQKITQTQPGMFVQEKEAVTLDCTYDTSDPSYGL FWYKQPSSGEMIFLIYQGSYDQQNATEGRYSLNFQKARKSANLVISASQLGDSA MYFCAMRTAGGTSYGKLTFGQGTILTVHPNIQNPDPAVYQLRDSKSSDKSVCLF TDFDSQTNVSQSKDSDVYITDKTVLDMRSMDFKSNSAVAWSNKSDFACANAFN NSIIPEDTFFPSPESSCDVKLVEKSFETDTNLNFQNLSVIGFRILLLKVAGFNLLMT LRLWSS | TCR 9 - Alpha Native Homo sapiens (aa) |

SEQUENCE TABLE-continued

| SEQ ID NO. | SEQUENCE | DESCRIPTION |
|---|---|---|
| 131 | MSLSLLKVTASLWLGPGIAQKITQTQPGMFVQEKEAVTLDCTYDTSDPSYGL FWYKQPSSGEMIFLIYQGSYDQQNATEGRYSLNFQKARKSANLVISASQLGDSA MYFCAMRTAGGTSYGKLTFGQGTILTVHPNIQNPDDPAVYQLRDSKSSDKSVCLF TDFDSQTNVSQSKDSDVYITDKCVLDMRSMDFKSNSAVAWSNKSDFACANAFN NSIIPEDTFFPSPESSCDVKLVEKSFETDTNLNFQNLSVIGFRILLLKVAGFNLLMT LRLWSS | TCR 9 – Alpha Cysteine-modified Homo sapiens (aa) |
| 132 | MSLGLLCCGAFSLLWAGPVNAGVTQTPKFRVLKTGQSMTLLCAQDMNHEYMY WYRQDPGMGLRLIHYSVGEGTTAKGEVPDGYNVSRLKKQNFLLGLESAAPSQT SVYFCASSYFGTAYEQYFGPGTRLTVTEDLKNVFPPEVAVFEPSEAEISHTQKAT LVCLATGFYPDHVELSWWVNGKEVHSGVSTDPQPLKEQPALNDSRYCLSSRLR VSATFWQNPRNHFRCQVQFYGLSENDEWTQDRAKPVTQIVSAEAWGRADCGF TSESYQQGVLSATILYEILLGKATLYAVLVSALVLMAMVKRKDSRG | TCR 9 – Beta Native Homo sapiens (aa) |
| 133 | MSLGLLCCGAFSLLWAGPVNAGVTQTPKFRVLKTGQSMTLLCAQDMNHEYMY WYRQDPGMGLRLIHYSVGEGTTAKGEVPDGYNVSRLKKQNFLLGLESAAPSQT SVYFCASSYFGTAYEQYFGPGTRLTVTEDLKNVFPPEVAVFEPSEAEISHTQKAT LVCLATGFYPDHVELSWWVNGKEVHSGVCTDPQPLKEQPALNDSRYCLSSRLR VSATFWQNPRNHFRCQVQFYGLSENDEWTQDRAKPVTQIVSAEAWGRADCGF TSESYQQGVLSATILYEILLGKATLYAVLVSALVLMAMVKRKDSRG | TCR 9 – Beta Cysteine-modified Homo sapiens (aa) |
| 134 | MMISLRVLLVILWLQLSWVWSQRKEVEQDPGPFNVPEGATVAFNCTYSNSASQ SFFWYRQDCRKEPKLLMSVVSSGNEDGRFTAQLNRASQYISLLIRDSKLSDSATY LCVVNFPSRGAGGTSYGKLTFGQGTILTVHPNIQKPDPAVYQLRDSKSSDKSVCL FTDFDSQTNVSQSKDSDVYITDKTVLDMRSMDFKSNSAVAWSNKSDFACANAF NNSIIPADTFFPSPESSCDVKLVEKSFETDTNLNFQNLSVIGFRILLLKVAGFNLLM TLRLWSS | TCR 10 – Alpha Native Homo sapiens (aa) |
| 135 | MMISLRVLLVILWLQLSWVWSQRKEVEQDPGPFNVPEGATVAFNCTYSNSASQ SFFWYRQDCRKEPKLLMSVVSSGNEDGRFTAQLNRASQYISLLIRDSKLSDSATY LCVVNFPSRGAGGTSYGKLTFGQGTILTVHPNIQKPDPAVYQLRDSKSSDKSVCL FTDFDSQTNVSQSKDSDVYITDKCVLDMRSMDFKSNSAVAWSNKSDFACANAF NNSIIPADTFFPSPESSCDVKLVEKSFETDTNLNFQNLSVIGFRILLLKVAGFNLLM TLRLWSS | TCR 10 – Alpha Cysteine-modified Homo sapiens (aa) |
| 136 | TSDQSYG | TCR 3/ TCR 5/ TCR 15/ TCR 19/ TCR 21/ TCR 23/ TCR 24/ TCR 25/ TCR 26/ TCR 29 – (E6)29 – TCR alpha CDR1 Homo sapiens (aa) |
| 137 | QGSYDEQN | TCR 3/ TCR 5/ TCR 15/ TCR 19/ TCR 21/ TCR 23/ TCR 25 / TCR 26/ |

SEQUENCE TABLE-continued

| SEQ ID NO. | SEQUENCE | DESCRIPTION |
|---|---|---|
| 138 | AMREGRGFKTI | TCR 29 - (E6)29/ - TCR alpha CDR2 Homo sapiens (aa) |
| 139 | SGHVS | TCR 3 alpha CDR3 Homo sapiens (aa) |
| 140 | FQNEAQ | TCR 3/ TCR 13/ TCR 37/ TCR 53 Beta CDR1 Homo sapiens (aa) |
| 141 | ASSHLAGFTGELF | TCR 3/TCR 4/ TCR 13/ TCR 37- (E6)29Beta CDR2 Homo sapiens (aa) |
| 142 | TISGTDY | TCR 3 Beta CDR3 Homo sapiens |
| 143 | GLTSN | TCR 4/ TCR 27 - (E6)29/ TCR 11 alpha CDR1 Homo sapiens (aa) |
| 144 | ILLVIRGTSYGKLT | TCR 4/ TCR 27 - (E6)29/ TCR 11 alpha CDR2 Homo sapiens (aa) |
| 145 | SEHNR | TCR 4 - (E6)29 alpha CDR3 Homo sapiens (aa) |
| | | TCR 4 - (E6)29 Beta CDR1 Homo sapiens (aa) |

SEQUENCE TABLE-continued

| SEQ ID NO. | SEQUENCE | DESCRIPTION |
|---|---|---|
| 146 | ASSPGGGNTEAF | TCR 4 - (E6)29 Beta CDR3 Homo sapiens (aa) |
| 147 | AMREGTGTSYGKLT | TCR 5 - (E6)29 - TCR alpha CDR3 Homo sapiens (aa) |
| 148 | MDHEN | TCR 5/ TCR 16/ TCR 17/ TCR 18/ TCR 19/ TCR 23 /TCR 24 /TCR 25/ TCR 28 - (E6)29/ TCR 8/ TCR 10/ TCR 14 - TCR beta CDR1 Homo sapiens (aa) |
| 149 | SYDVKM | TCR 5/ TCR 16/ TCR 17/ TCR 18/ TCR 19/ TCR 23/ TCR 24/ TCR 25/ TCR 28 - (E6)29 / TCR 8/ TCR 10/ TCR 14 - TCR beta CDR2 Homo sapiens (aa) |
| 150 | ASSPWGETHQPQH | TCR 5 - (E6)29 - TCR beta CDR3 Homo sapiens (aa) |
| 151 | DSSSTY | TCR 6, TCR 12, TCR 50, TCR 55 alpha CDR1 Homo sapiens (aa) |
| 152 | IFSNMDM | TCR 6, TCR 12, TCR 50, TCR 55 alpha CDR2 Homo sapiens (aa) |
| 153 | AESIRGFGNVLH | TCR 6 alpha CDR3 |

| SEQ ID NO. | SEQUENCE | DESCRIPTION |
|---|---|---|
| | | Homo sapiens (aa) |
| 154 | SNHLY | TCR 6/ TCR 7 - (E7)11, E7(11-19)/ TCR 12 consensus, TCR 30/ TCR 33/ TCR 36/ TCR 39 /TCR 40/ TCR 41/ TCR 42/ TCR 43/ TCR 47/ TCR 48/ TCR 49/ TCR 51/ TCR 54/ TCR 55 Beta CDR1 Homo sapiens (aa) |
| 155 | FYNNEI | TCR 6/ TCR 7 - (E7)11, E7(11-19)/ TCR 12 consensus, TCR 30/ TCR 33/ TCR 36/ TCR 39/ TCR 42/ TCR 43 / TCR 47/ TCR 48/ TCR 49/ TCR 51/ TCR 54/ TCR 55 Beta CDR2 Homo sapiens (aa) |
| 156 | ASTTRSSYEQY | TCR 6/ TCR 12/ TCR 55 Beta CDR3 Homo sapiens (aa) |
| 157 | VSPFSN | TCR 7/ TCR 54 alpha CDR1 Homo sapiens (aa) |
| 158 | MTFSENT | TCR 7/ TCR 54- (E7)11 - alpha CDR2 Homo sapiens (aa) |
| 159 | VVSRDNYGQNFV | TCR 7/ TCR 54 - (E7)11 - alpha CDR3 Homo sapiens (aa) |
| 160 | AITDRTNYGYT | TCR 7/ TCR 54- (E7)11 -Beta CDR3 |

SEQUENCE TABLE-continued

| SEQ ID NO. | SEQUENCE | DESCRIPTION |
|---|---|---|
| | | Homo sapiens (aa) |
| 161 | DSAIYN | TCR 8/ TCR 16/ TCR 18 alpha CDR1 Homo sapiens (aa) |
| 162 | IQSSQRE | TCR 8/ TCR 16/ TCR 18 alpha CDR2 Homo sapiens (aa) |
| 163 | AVRPLGNTPLV | TCR 8 alpha CDR3 Homo sapiens (aa) |
| 164 | ASSLWGASTDTQY | TCR 8 Beta CDR3 Homo sapiens (aa) |
| 165 | TSDPSYG | TCR 9/ TCR 17 alpha CDR1 Homo sapiens (aa) |
| 166 | QGSYDQQN | TCR 9/ TCR 17 alpha CDR2 Homo sapiens (aa) |
| 167 | AMRTAGGTSYGKLT | TCR 9 alpha CDR3 Homo sapiens (aa) |
| 168 | MNHEY | TCR 9/ TCR 26 Beta CDR1 Homo sapiens (aa) |
| 169 | SVGEGT | TCR 9/ TCR 26 Beta CDR2 Homo sapiens (aa) |

SEQUENCE TABLE-continued

| SEQ ID NO. | SEQUENCE | DESCRIPTION |
|---|---|---|
| 170 | ASSYPGTAYEQY | TCR 9 Beta CDR3 Homo sapiens (aa) |
| 171 | NSASQS | TCR 10/ TCR 28/ TCR 36/ TCR 41 alpha CDR1 Homo sapiens (aa) |
| 172 | VYSSGN | TCR 10/ TCR 28/ TCR 41 alpha CDR2 Homo sapiens (aa) |
| 173 | VVNFPSRGAGGTSYGKLT | TCR 10 alpha CDR3 Homo sapiens (aa) |
| 174 | ASSLSLTGNYGYT | TCR 10 Beta CDR3 Homo sapiens (aa) |
| 175 | ILSAHSNSGYALN | TCR 11 alpha CDR3 Homo sapiens (aa) |
| 176 | SQVTM | TCR 11 Beta CDR1 Homo sapiens (aa) |
| 177 | ANQGSEA | TCR 11 Beta CDR2 Homo sapiens (aa) |
| 178 | SVVPWTRGGSTDTQY | TCR 11 Beta CDR3 Homo sapiens (aa) |

| SEQ ID NO. | SEQUENCE | DESCRIPTION |
|---|---|---|
| 179 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLILESASTNQTSM YLCASSLSLTGNYGYTFGSGTRLITVVEDLNKVFPPEVAVFEPSEAEISHTQKATL VCLATGFFPDHVELSWWVNGKEVHSGVSTDPQPLKEQPALNDSRYCLSSRLRVS ATFWQNPRNHFRCQVQFYGLSENDEWTQDRAKPVTQIVSAEAWGRADCGFTS VSYQQGVLSATILYEILLGKATLYAVLVSALIVLMAMVKRKDF | TCR 10- Beta Native Homo sapiens (aa) |
| 180 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLILESASTNQTSM YLCASSLSLTGNYGYTFGSGTRLITVVEDLNKVFPEVAVFEPSEAEISHTQKATL VCLATGFFPDHVELSWWVNGKEVHSGVCTDPQPLKEQPALNDSRYCLSSRLRV SATFWQNPRNHFRCQVQFYGLSENDEWTQDRAKPVTQIVSAEAWGRADCGFTS VSYQQGVLSATILYEILLGKATLYAVLVSALIVLMAMVKRKDF | TCR 10- Beta Cysteine-modified Homo sapiens (aa) |
| 181 | MSLSSLLKVVTASLWLGPGI | TCR 3/ TCR 9/ TCR 5/ TCR 15/ TCR 17/ TCR 19/ TCR 21/ TCR 23/ TCR 24/ TCR 25/ TCR 26/ TCR 29 - (E6)29 TCR alpha signal peptide Homo sapiens (aa) |
| 182 | MGTRLLCWVLGFLGTDHT | TCR 3/ TCR 13/ TCR 37 - Beta signal peptide Homo sapiens (aa) |
| 183 | ATGAAGACATTTGCTGGATTTTCGTTCCTGTTTTTGTGGCTGCAGCTGGACTG TATGAGTAGAGGAGGATGTGGAGCAGAGTCTTTTCCTGAGTGTCCGAGAG GGAGAGCAGCTCCGTTATAAGCAGGAACCTGCACTTACACAGACAGCTCCTCCACCTACT TATACTGGTATAAGCAAGAACATGAAACAAGACCAAAGACTCACTGTTCTATTGAAT TTTTCAAATATGCAATTGTCTCTGCGACCATTGCAGACACCCCAGACTGGGACT CAGCTATCTACTTCTGTGCAGTCCCCTCGGGTGCTACAAACAAGCTCATCTTT GGAACTGGACACTCTGTCTTGCTGTCCAAATATCCAGAACCCTGACCCTG CCGTGTACCAGCTGAGAGACTCTAAATCCAGTGACAAAGTAAGGATTCTGATGTG TATATCACAGACAAATGCGTCTAGACATGAGGTCTATGCATGTGCAAACGCCTT ACAGCTGTGGCCTGGAGCAACAAATTGACTTTGCATGTGCAAACGCCTT CAACAACAGCATTATTCCAGAAGACACACCTTCTTCCCAGCCCAGAAAGTTCC TGTGATGTCAAGCTGGTCGTGGAGAAATGTTTGAACAGATACGAACCTAAACT TTCAAAACCTGTCAGTGATTGGGTTCCGAATCCTCCTGAAAGTGGCCGG GTTTAATCTGCTCATGACGCTGCGGCTG | TCR 12 - Alpha Native Homo sapiens (nt) |
| 184 | MKLVTSITVLLSLGIMG | TCR 4/ TCR 27- (E6)29 alpha signal |

| SEQ ID NO. | SEQUENCE | DESCRIPTION |
|---|---|---|
| 185 | MGTSLLCWMALCLLGADHADT | TCR 4 - (E6)29 Beta signal peptide Homo sapiens (aa) |
| 186 | MGIRLLCRVAFCFLAVGLV | TCR 5/ TCR 16/ TCR 17/ TCR 18/ TCR 19/ TCR 23/ TCR 24/ TCR 25/ TCR 28 - (E6)29/ TCR 8/ TCR10/ TCR 14 - TCR beta signal peptide Homo sapiens (aa) |
| 187 | MKTFAGFSFLFLWLQLDCMSR | TCR 6/ TCR 12/ TCR 50/ TCR 55- alpha signal peptide Homo sapiens (aa) |
| 188 | MDTWLVCWAIFSLLKAGLT | TCR 6/7/12/33/36/39/ 43/47/49/51/54/55/30 - Beta signal peptide Homo sapiens (aa) |
| 189 | MKKHLTTFLVILWLYFRGNG | TCR 7/ TCR 54- (E7)11 - alpha signal peptide Homo sapiens (aa) |
| 190 | METLLGLLIWLQLQWVSS | TCR 8/ TCR 16/ TCR 18 - alpha signal peptide Homo sapiens (aa) |
| 191 | MSLGLLCCGAFSLLWAGPV | TCR 9/ TCR 26- Beta signal peptide Homo sapiens (aa) |

SEQUENCE TABLE-continued

| SEQ ID NO. | SEQUENCE | DESCRIPTION |
|---|---|---|
| 192 | MMISLRVLIVILWLQLSWVWSQ | TCR 10/ TCR 28/ TCR 36/ TCR 41 - alpha signal peptide Homo sapiens (aa) |
| 193 | MKLVTSITVLLSLGIMG | TCR 11 - alpha signal peptide Homo sapiens (aa) |
| 194 | MLSLLLLLGLGSVF | TCR 11 - Beta signal peptide Homo sapiens (aa) |
| 195 | MKLVTSITVLLSLGIMGDAKTTQPNSMESNEEEPVHLPCNHSTISGTDYIHWYRQ LPSQGPEYVIHGLTSNVNNRMASLAIAEDRKSSTLILHRATLRDAAVYYCILSAH SNSGYALNFGKGTSLLVTPHIQNPDPAVYQLRDSKSSDKSVCLFTDFDSQTNVSQ SKDSDVYITDKTVLDMRSMDFKSNSAVAWSNKSDFACANAFNNSIIPEDTFFPSP ESSCDVKLVEKSFETDTNLNFQNLSVIGFRILLLKVAGFNLLMTLRLWSS | TCR 11 - Alpha Native Homo sapiens (aa) |
| 196 | NIQNPDPAVYQLRDSKSSDKSVCLFTDFDSQTNVSQSKDSDVYITDKCVLDMRS MDFKSNSAVAWSNKSDFACANAFNNSIIPEDTFFPSPESSCDVKLVEKSFETDTN LNFQNLSVIGFRILLLKVAGFNLLMTLRLWSS | TCR 4 - (E6)29 / TCR 5 - (E6)29/ TCR 12/ TCR 55 - TCR alpha constant region Homo sapiens (aa) |
| 197 | EDLNKVFPPEVAVFEPSEAEISHTQKATLVCLATGFFPDHVELSWWVNGKEVHS GVCTDPQPLKEQPALNDSRYCLSSRLRVSATFWQNPRNHFRCQVQFYGLSENDE WTQDRAKPVTQIVSAEAWGRADCGFTSVSYQQGVLSATIYEILLGKATLYAVL VSALVLMAMVKRKDF | TCR 4/5/7/10/14/16/17/18/21/ 22/23/25/27/28/30/37/ 39/50/54 - TCR beta constant region Homo sapiens (aa) |
| 198 | NIQKPDPAVYQLRDSKSSDKSVCLFTDFDSQTNVSQSKDSDVYITDKCVLDMRS MDFKSNSAVAWSNKSDFACANAFNNSIIPADTFFPSPESSCDVKLVEKSFETDTN LNFQNLSVIGFRILLLKVAGFNLLMTLRLWSS | TCR 3/ TCR 10 TCR alpha constant region Homo sapiens (aa) |
| 199 | EDLKNVFPPEVAVFEPSEAEISHTQKATLVCLATGFFPDHVELSWWVNGKEVHS GVCTDPQPLKEQPALNDSRYCLSSRLRVSATFWQNPRNHFRCQVQFYGLSENDE WTQDRAKPVTQIVSAEAWGRADCGFTSESYQQGVLSATILYEILLGKATLYAVL VSALVLMAMVKRKDSRG | TCR 3/6/8/9/11/13/19/ 20/24/29/31/32/33/34/ 35/36/38/ 40/41/42/43/ 45/46/47/48/49/51/52/55 - TCR beta constant |

SEQUENCE TABLE-continued

| SEQ ID NO. | SEQUENCE | DESCRIPTION |
|---|---|---|
| 200 | HIQNPDPAVYQLRDSKSSDKSVCLFTDFDSQTNVSQSKDSDVYITDKCVLDMRS MDFKSNSAVAWSNKSDFACANAFNNSIIPEDTFFPSPESSCDVKLIVEKSFETDTN LNFQNLSVIGFRILLLKVAGFNLLMTLRLWSS | region Homo sapiens (aa) |
| 201 | YIQNPDPAVYQLRDSKSSDKSVCLFTDFDSQTNVSQSKDSDVYITDKCVLDMRS MDFKSNSAVAWSNKSDFACANAFNNSIIPEDTFFPSPESSCDVKLIVEKSFETDTN LNFQNLSVIGFRILLLKVAGFNLLMTLRLWSS | TCR 6/ TCR 11 alpha constant region Homo sapiens (aa) |
| 202 | ATGCTCCTGCTGCTCCGTCCTCGAGGTCTGAGGTCGATTTTTACTCTGGGAGGAAC CAGAGCCCAGTCCGGTTGACAGCCAGTCCACGTCTCTGTCTCTGAAGGA ACCCCGGTCGTCTGAGGTGCAACAAACCCCAACAGGACTCCAGCTTCTCCTGAAGTACACA CTGTATGTGCAACACCCCAACAAAGGACTCCAGCTTCTCCTGAAGTACACA TCAGCGGCCACCCTGGTTAAAGGCATCAACGGTTTGAGCTGAATTAAGA AGAGTGAAACCTCCTTCGACGAAACCCTGACGAATCCCATATGAGGCACGC GGCTGAGTACTTCTGTGTTGAGGGAGGAAAGCTTATCTTCGGACAGGGA ACGGAGTTATCTGTGAAACCCAATATGAACCCAGAACCCTGACCCTGTACC AGCTGAGAGACTCTAAATCCAGTGACAAGTCTGTCTGCCTATTCACCGATTTT GATTCTCAAACAAATGTGTCACAAGTAAGGATTCTGATGTGTATATCACAG ACAATGCGTGCAACATGAGGTCTATGACTTCAAGAGCAACAGTGCTGT GGCCTGGAGCAACAAATCTGACTTTGCATGTGCAAACGCCTTCAACAGC ATTATTCCAGAAGACACCTTCTTCCCAGCCAGATACGAACCTAAACTTTCAAAACCT AGCTGTGATTGGGTTCCGAATCCTCCTGAAAGTGGCCGGGTTTAATCTGC TCATGACGCTGCGCTG | TCR 13 - Alpha Native Homo sapiens (nt) |
| 203 | NIQNPDPAVYQLRDSKSSDKSVCLFTDFDSQTNVSQSKDSDVYITDKCVLDMRS MDFKSNSAVAWSNKSDFACANAFNNSIIPEDTFFPSPESSCDVKLIVEKSFETDTN LNFQNLSVIGFRILLLKVAGFNLLMTLRLWSS | TCR 8/9/13/16/17/18/21/26/ 27/28/30/31/32/33/34/35/ 37/38/39/40/41/42/43/ 44/45/46/48/49/50/51/ 52/53 - alpha constant region Homo sapiens (aa) |
| 204 | GSGATNFSLLKQAGDVEENPGP | P2A Artificial (aa) |

SEQUENCE TABLE-continued

| SEQ ID NO. | SEQUENCE | DESCRIPTION |
|---|---|---|
| 205 | MKLVTSITVLLSLGIMGDAKTTQPNSMESNEEEPVHLPCNHSTISGTDYIHWYRQ LPSQGPEYVIHGLTSNVNNRMASLAIAEDRKSSTLHLHRATLRDAAVYYCILSAH SNSGYALNFGKGTSLLVTPHIQNPDPAVVQLRDSKSSDKSVCLFTDFDSQTNVSQ SKDSDVYITDKCVLDMRSMDFKSNSAVAWSNKSDFACANAFNNSIIPEDTFFPSP ESSCCDVKLVEKSFETDTNLNFQNLSVIGFRILLLKVAGFNLLMTLRLWSS | TCR 11 - Alpha Cysteine-modified Homo sapiens (aa) |
| 206 | MLSLLLLLGLGSVFSAVISQKPSRDICQRGTSLTIQCQVDSQVTMMFWYRQQP GQSLTLIATANQGSEATYESGFVIDKFPISRPNLTFSTLTVSNMSPEDSSIYLCSVV PWTRGGSTDTQYFGPGTRLTVLEDLKNVFPPEVAVFEPSEAEISHTQKATLVCLA TGFYPDHVELSWWNGKEVHSGVSTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVSALVLMAMVKRKDSRG | TCR 11 - Beta Native Homo sapiens (aa) |
| 207 | GGATCCGGAGCTACCAACTTCTCTCTGCTGAAACAGGCCAGGCGATGTGGAGG AAAATCCTGGGCCA | TCR 3/ TCR 6/ TCR 8/ TCR 9/ TCR 10 TCR 11 P2A Artificial (nt) |
| 208 | GGGAGTGGAGCAACAAACTTTTCACTGCTGAAGCAGGCCCGGCGATGTGGAG GAAAATCCTGGGCCA | TCR 4 P2A Artificial (nt) |
| 209 | GGGTCCGGAGCCACAAATTTTCTCTGCTGAAACAGGCTGGCGATGTGGAGG AAAACCCTGGGCCA | TCR 5 P2A Artificial (nt) |
| 210 | GGAAGCGGCCAACAAACTTTTCCCTGCTGAAACAGGCCCGGAGATGTGGAG GAAAATCCTGCCCA | TCR 7 P2A Artificial (nt) |
| 211 | EGRGSLLTCGDVEENPGP | T2A Artificial (aa) |
| 212 | NIQKPDPAVVQLRDSKSSDKSVCLFTDFDSQTNVSQSKDSDVYITDKTVLDMRS MDFKSNSAVAWSNKSDFACANAFNNSIIPADTFFPSPESSCDVKLVEKSPETDTN LNFQNLSVIGFRILLLKVAGFNLLMTLRLWSS | TCR 3/ TCR 10 Native TCR alpha constant region Homo sapiens (aa) |

SEQUENCE TABLE-continued

| SEQ ID NO. | SEQUENCE | DESCRIPTION |
|---|---|---|
| 213 | NIQNPDPAVYQLRDSKSSDKSVCLFTDFDSQTNVSQSKDSDVYITDKTVLDMRS MDFKSNSAVAWSNKSDFACANAFNNSIIPEDTFFPSPESSCDVKLVEKSFETDTN LNFQNLSVIGFRILLLKVAGFNLLMTLRLWSS | TCR 4/5/12/8/9/13/16/17/18/ 21/26/27/28/30/31/32/ 33/34/35/37/38/39/40/ 41/42/43/44/45/46/48/ 49/50/51/52/53/55 - Native TCR alpha constant region Homo sapiens (aa) |
| 214 | EDLNKVFPPEVAVFEPSEAEISHTQKATLVCLATGFFPDHVELSWWVNGKEVHS GVSTDPQPLKEQPALNDSRYCLSSRLRVSATFWQNPRNHFRCQVQFYGLSENDE WTQDRAKPVTQIVSAEAWGRADCGFTSVSYQQGVLSATILYEILLGKATLYAVL VSALVLMAMVKRKDF | TCR 4/5/16/17/18/21/22/23/ 25/27/28/7/37/39/50/51/ 52/54/10/14 - Native TCR beta constant region Homo sapiens (aa) |
| 215 | PNIQKPDPAVYQLRDSKSSDKSVCLFTDFDSQTNVSQSKDSDVYITDKTVLDMR SMDFKSNSAVAWSNKSDFACANAFNNSIIPADTFFPSPESSCDVKLVEKSFETDT NLNFQNLSVIGFRILLLKVAGFNLLMTLRLWSS | TCR 3/ TCR 10 Native TCR alpha constant region Homo sapiens (aa) |
| 216 | EDLKNVFPPEVAVFEPSEAEISHTQKATLVCLATGFYPDHVELSWWVNGKEVHS GVSTDPQPLKEQPALNDSRYCLSSRLRVSATFWQNPRNHFRCQVQFYGLSENDE WTQDRAKPVTQIVSAEAAWGRADCGFTSESYQQGVLSATILYEILLGKATLYAVL VSALVLMAMVKRKDSRG | TCR 3/6/12/9/11/13/19/20/ 24/29/31/32/33/34/35/36/ 38/40/41/42/43/46/47/ 48/49/53/55 Native TCR beta constant region Homo sapiens (aa) |
| 217 | HIQNPDPAVYQLRDSKSSDKSVCLFTDFDSQTNVSQSKDSDVYITDKTVLDMRS MDFKSNSAVAWSNKSDFACANAFNNSIIPEDTFFPSPESSCDVKLVEKSFETDTN LNFQNLSVIGFRILLLKVAGFNLLMTLRLWSS | TCR 6/ TCR 11 Native TCR alpha constant region Homo sapiens (aa) |
| 218 | YIQNPDPAVYQLRDSKSSDKSVCLFTDFDSQTNVSQSKDSDVYITDKTVLDMRS MDFKSNSAVAWSNKSDFACANAFNNSIIPEDTFFPSPESSCDVKLVEKSFETDTN LNFQNLSVIGFRILLLKVAGFNLLMTLRLWSS | TCR 7/ TCR 14/ TCR 15/ TCR 20/ TCR 36/ TCR 54 - Native TCR alpha constant region |

SEQUENCE TABLE-continued

| SEQ ID NO. | SEQUENCE | DESCRIPTION |
|---|---|---|
| | | *Homo sapiens* (aa) |
| 219 | ATGGAGAAGAATCTTTGGCAGCCCCATTACTAATCCTCTGGTTTCATCTTGA CTGCCTGAGCAGCATACTGAACGTGGAACAAAAGTCCTCAGTCACTCATGTT CAGGAGGGAGACAGCACCAATTTCACCTGCAGCTTCCCTTCCAGCAATTTT ATGCCTTACACTGGTACACGATGGGAAACTGCAAAAAGCCCCGAGCCTTGTT TGTAATGACTTTAAATGGGATGAAAAGAAGAAAGGACGAATAAGTGCCAC TCTTAATACCAAGAGAGGGTTACAGCTATTTGTACATCAAAGGATCCAGCCT GAAGACTCAGCCACTACCTCTGTCCCTCTCAAACTGGGCAAACAACCTCT TCTTTGGGACTCGGAACGAGACTCACCGTTATTCCCTATATCCAGAACCCTGA CCCTGCCGTGTACCAGCTGAGAGACTCTAAATCCAGTCGACAAGTCTGTCGC CTATTCACCGATTTTGATTCTCAAACAAATGTGTCACAAGTAAGGATTCTG GAGCACAGTGCTGTGGCCTGGAGCACAAATCTGACTTTGCATGTGCAAAC GCCTTCAACAACAGCATTATTCCAGAAGACACCTTCTTCCCAGCCAGAACCT GTTCCTGTGATGTCAAGCTGGTCGAGAAAAGCTTTGAACAGATACGAACCT AAACTTTCAAACCTGTCAGTGATTGGGTTCCGAATCCTCCTCTGAAAGTG GCCGGTTTAATCTGCTCATGACGCTGCGGCTG | |
| 220 | PNIQNPDPAVYQLRDSKSSDKSVCLFTDFDSQTNVSQSKDSDVYITDKTVLDMR SMDFKSNSAVAWSNKSDFACANAFNNSIIPEDTFFPSPESSCDVKLVEKSFETDT NLNFQNLSVIGFRILLLKVAGFNLLMTLRLWSS | TCR 4 - (E6)29 / TCR 5/ TCR 12 /TCR 8/ TCR 9/ TCR 13- (E6)29 - Native TCR alpha constant region *Homo sapiens* (aa) |
| 221 | MLSLLLLLGLGSVFSAVISQKPSRDICQRGTSLTIQCQVDSQVTMMFWYRQQP GQSLTLIATANQGSEATYESGFVIDKFPISRPNLTFSTLTVSNMSPEDSSIYLCSVV PWTRGGSTDTQYFGPGTRLTVLEDLKNVFPPEVAVFEPSEAEISHTQKATLVCLA TGFYPDHVELSWWVNGKEVHSGVCTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVSALVLMAMVKRKDSRG | TCR 11 - Beta Cysteine-modified *Homo sapiens* (aa) |
| 222 | MKTFAGFSFLFLWLQLDCMSRGEDVEQSLFLSVREGDSSVINCTYTDSSSTYLY WYKQEPGAGLQLLTYIFSNMDMKQDQRLTVLLNKKDKHLSLRIADTQTGDSAI YFCAVPSGATNKLIFGTGTLLAVQPNIQNPDPAVYQLRDSKSSDKSVCLFTDFDS QTNVSQSKDSDVYITDKTVLDMRSMDFKSNSAVAWSNKSDFACANAFNNSIIPE DTFFPSPESSCDVKLVEKSFETDTNLNFQNLSVIGFRILLLKVAGFNLLMTLRLWS S | TCR 12/ TCR 55- (E7)11 -alpha native *Homo sapiens* (aa) |
| 223 | MGTRLLCWVLGLGTDHTGAGVSQSPRYKVAKRGQDVALRCDPISGHVSLF WYQQALGQGPEFLTYFQNEAQLDKSGLPSDRFFAERPEGSVSTLKIQRTQEDS AVYLCASSHLAGFTGELFFGEGSRLTVLEDLKNVFPPEVAVFEPSEAEISHTQKA TLVCLATGFYPDHVELSWWVNGKEVHSGVSTDPQPLKEQPALNDSRYCLSSRL RVSATFWQNPRNHFRCQVQFYGLSENDEWTQDRAKPVTQIVSAEAWGRADCG FTSESYQQGVLSATILYEILLGKATLYAVLVSALVLMAMVKRKDSRGGSGATNF | TCR 3 Full sequence Native *Homo sapiens* (aa) |

SEQUENCE TABLE-continued

| SEQ ID NO. | SEQUENCE | DESCRIPTION |
|---|---|---|
| | SLLKQAGDVEENPGPMSLSSLLKVVTASLWLGPGIAQKITQTQPGMFVQEKEAV TLDCTYDTSDQSYGLFWYKQPSSGEMIFLIYQGSYDEQNATEGRYSLNFQKARK SANLVISASQLGDSAMYFCAMREGRGFKTIFGAGTRLFVKANIQKPDPAVYQLR DSKSSDKSVCLFTDFDSQTNVSQSKDSDVYITDKTVLDMRSMDFKSNSAVAWS NKSDFACANAFNNSIIPADTFFPSPESSCDVKLVEKSFETDTNLNFQNLSVIGFRIL LLKVAGFNLLMTLRLWSS | |
| 224 | MGTSLLCWMALCLLGADHADTGVSQDPRHKITKRGQNVTFRCDPISEHNRLYW YRQTLGQGPEFLTYFQNEAQLEKSRLLSDRFSAERPKGSFSTLEIQRTEQGDSAM YLCASSPGGGNTEARFGQGTRLITVEDLNKVFPPEVAVFEPSEAEISHTQKATLV CLATGFFPDHVELSWWVNGKEVHSGVSTDPQPLKEQPALNDSRYCLSSRLRVSA TFWQNPRNHFRCQVQFYGLSENDEWTQDRAKPVTQIVSAEAWGRADCGFTSVS YQQGVLSATILYEILLGKATLYAVLVSALVLMAMVKRKDFGSGATNFSLLKQA GDVEENPGMKLVTSITVLLSLGIMGDAKTTQPNSMESNEEPVHLPCNHSTISG TDYIHWYRQLPSQGPEYVIHGLTSNVNNRMASLAIAEDRKSSTLLHRATLRDAA VYYCILLVIRGTSYGKLTFGQGTLITVHPNIQNPDPAVYQLRDSKSSDKVCLFTD FDSQTNVSQSKDSDVYITDKTVLDMRSMDFKSNSAVAWSNKSDFACANAFNNS IIPEDTFFPSPESSCDVKLVEKSFETDTNLNFQNLSVIGFRILLLKVAGFNLLMTLR LWSS | TCR 4 – (E6)29 – Full sequence Native Homo sapiens (aa) |
| 225 | MGIRLLCRVAFCFLAVGLVDVKVTQSSRYLVKRTGEKVFLECVQDMDHENMF WYRQDPGLGRLIYFSYDVKMKEKGDIPEGYSVSREKKERFSLLLESASTNQTSM YLCASSPWGETHQPOHFGDGTRLSILEDLNKVFPPEVAVFEPSEAEISHTQKATL VCLATGFFPDHVELSWWVNGKEVHSGVSTDPQPLKEQPALNDSRYCLSSRLRVS ATFWQNPRNHFRCQVQFYGLSENDEWTQDRAKPVTQIVSAEAWGRADCGFTS VSYQQGVLSATILYEILLGKATLYAVLVSALVLMAMVKRKDFGSGATNFSLLKQ AGDVEENPGMSLSSLLKVVTASLWLGPGIAQKITQTQPGMFVQEKEAVTLDCT YDTSDQSYGLFWYKQPSSGEMIFLIYQGSYDEQNATEGRYSLNFQKARKSANLV ISASQLGDSAMYFCAMREGTGTSYGKLTFGQGTLITVHPNIQNPDPAVYQLRDS KSSDKSVCLFTDFDSQTNVSQSKDSDVYITDKTVLDMRSMDFKSNSAVAWSNK SDFACANAFNNSIIPEDTFFPSPESSCDVKLVEKSFETDTNLNFQNLSVIGFRILLL KVAGFNLLMTLRLWSS | TCR 5 – (E6)29 – Full sequence Native Homo sapiens (aa) |
| 226 | MDTWLVCWAIFSLLKAGLITEPEVTQTPSHQVTQMGQEVILRCVPISNHLYFYWY RQILGQKVEFLIVSFYNNEISEKSEIFDDQFSVERPDGSNFTLKIRSTKLEDSAMYF CASTTRSSYRQYFGPGTRLTVTEDLKNVFPPEVAVFEPSEAEISHTQKATLVCLA TGFYPDHVELSWWVNGKEVHSGVSTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVSALVLMAMVKRKDSRGGSGATNFSLLKQ AGDVEENPGMKTFAGFSFLFLWLQLDCMSRGEDVEQSLFLSVREGDSSVINCT YTDSSSTYLYWYKQEPGAGLQLLTYIFSNMDMKQDQRLTVLLNKKDKHLSLRI ADTQTGDSAIYFCAESIRGFGNVLHCGSGTQVIVLPHIQNPDPAVYQLRDSKSSD KSVCLFTDFDSQTNVSQSKDSDVYITDKTVLDMRSMDFKSNSAVAWSNKSDFA CANAFNNSIIPEDTFFPSPESSCDVKLVEKSFETDTNLNFQNLSVIGFRILLLKVAG FNLLMTLRLWSS | TCR 6 Full sequence Native Homo sapiens (aa) |
| 227 | MDTWLVCWAIFSLLKAGLITEPEVTQTPSHQVTQMGQEVILRCVPISNHLYFYWY RQILGQKVEFLIVSFYNNEISEKSEIFDDQFSVERPDGSNFTLKIRSTKLEDSAMYF CAITDRTNYGTFGSGTRLTVVEDLNKVFPPEVAVFEPSEAEISHTQKATLVCLA | TCR 7/ TCR 54 – (E7)11 – Full sequence |

SEQUENCE TABLE-continued

| SEQ ID NO. | SEQUENCE | DESCRIPTION |
|---|---|---|
| | TGFFPDHVELSWWNGKEVHSGVSTDPQPLKEQPALNDSRYCLSSRLRVSATF WQNPRNHFRCQVQFYGLSENDEWTQDRAKPVTQIVSAEAWGRADCGFTSVSY QQGVLSATILYEILLGKATLYAVLVMAMVKRKDFGSGATNFSLLKQAG DVEENPGPMKKHLITFLVILMLYFYRGNGKNQVEQSPQSLIILEGKNCTLQCNY TVSPFSNLRWYKQDTGRGPVSLTIMTFSENTKSNGRYTATLDADTKQSSLHITAS QLSDSASYICVVSRDNYGQNFVFGPGTRLSVLPYIQNPDPAVYQLRDSKSSDKSV CLFTFDFDSQTNVSQSKDSDVYITDKTVLDMRSMDFKSNSAVAWSNKSDFACAN AFNNSIIPEDTFFPSPESSCDVKLVEKSFETDTNLNFQNLSVIGFRILLLKVAGFNL LMTLRLWSS | Native Homo sapiens (aa) |
| 228 | MGIRLLCRVAFCFLAVGLVDVKVTQSSRYLIVKRTGEKVFLECVQDMDHENMF WYRQDPGLGLRLIYFSYDVKMKEKGDIPEGYSVSREKKERFSLIIESASTNQTSM YLCASSLWGASTDTQYFGPGTRLTVLEDLKNVFPPEVAVFEPSEAEISHTQKATL VCLATGFYPDHVELSWWNGKEVHSGVSTDPQPLKEQPALNDSRYCLSSRLRV SATFWQNPRNHFRCQVQFYGLSENDEWTQDRAKPVTQIVSAEAWGRADCGFTS ESYQQGVLSATILYEILLGKATLYAVLVSALVLMAMVKRKDSRGGSGATNFSLL KQAGDVEENPGPMETLLGLLILWLQLQWVSSKQEVTQIPAALSVPEGENLVLNC SFTDSAIYNLQWFRQDPDGKGLTSLLLIQSSQREQTSGRLNASLDKSSGRSTLYIAA SQPGDSATYLCAVRPLGNTPLVFGKGTRLSVIANIQNPDPAVYQLRDSKSSDKSV CLFTDFDSQTNVSQSKDSDVYITDKTVLDMRSMDFKSNSAVAWNKSDFACAN AFNNSIIPEDTFFPSPESSCDVKLVEKSFETDTNLNFQNLSVIGFRILLLKVAGFNL LMTLRLWSS | TCR 8 - Full sequence Native Homo sapiens (aa) |
| 229 | MSLGLLCCGAFSLLWAGPVNAGVTQTPKFRVLKTGQSMTLLCAQDMNHEYMY WYRQDPGMGLRLIHYSVGEGTTAKGEVPDGYNVSRLKKQNFLLGLESAAPSQT SVYFCASSYFGTAYEQYFGPGTRLTVTEDLKNVFPPEVAVFEPSEAEISHTQKAT LVCLATGFYPDHVELSWWNGKEVHSGVSTDPQPLKEQPALNDSRYCLSSRLR VSATFWQNPRNHFRCQVQFYGLSENDEWTQDRAKPVTQIVSAEAWGRADCGF TSESYQQGVLSATILYEILLGKATLYAVLVSALVLMAMVKRKDSRGGSGATNFS LLKQAGDVEENPGPMSLSSLLKVVTASLWLGPGIAQKITQTQPGMFVQEKEAVT LDCTYDTSDPSYGLFWYKQPSSGEMIFLIYQGSYDQQNATEGRYSLNFQKARKS ANLVISASQLGDSAMYFCAMRTAGGTSYGKLTFGQGTILTVHPNIQNPDPAVYQ LRDSKSSDKSVCLFTDFDSQTNVSQSKDSDVYITDKTVLDMRSMDFKSNSAVA WSNKSDFACANAFNNSIIPEDTFFPSPESSCDVKLVEKSFETDTNLNFQNLSVIGF RILLLKVAGFNLLMTLRLWSS | TCR 9 - Full sequence Native Homo sapiens (aa) |
| 230 | MGIRLLCRVAFCFLAVGLVDVKVTQSSRYLIVKRTGEKVFLECVQDMDHENMF WYRQDPGLGLRLIYFSYDVKMKEKGDIPEGYSVSREKKERFSLIIESASTNQTSM YLCASSLITGNYGYTFGSGTRLTVVEDLNKVFPPEVAVFEPSEAEISHTQKATL VCLATGFFPDHVELSWWNGKEVHSGVSTDPQPLKEQPALNDSRYCLSSRLRVS ATFWQNPRNHFRCQVQFYGLSENDEWTQDRAKPVTQIVSAEAWGRADCGFTS VSYQQGVLSATILYEILLGKATLYAVLVSALVLMAMVKRKDFGSGATNFSLLKQ AGDVEENPGPMMISLRVLLVILWLQLSWWSQRKEVEQDPGPFNVPEGATVAF NCTYSNSASQSFFWYRQDCRKEPKLLMSVYSSGNEDGRFTAQLNRASQYISLLIR DSKLSDSATYLCVVNFPSRGAGGTSYGKLTFGQGTILTVHPNIQKPDPAVYQLR DSKSSDKSVCLFTDFDSQTNVSQSKDSDVYITDKTVLDMRSMDFKSNSAVAWS NKSDFACANAFNNSIIPADTFFPSPESSCDVKLVEKSFETDTNLNFQNLSVIGFRIL LLKVAGFNLLMTLRLWSS | TCR 10 - Full sequence Native Homo sapiens (aa) |

SEQUENCE TABLE-continued

| SEQ ID NO. | SEQUENCE | DESCRIPTION |
|---|---|---|
| 231 | MLSLLLLLLGLGSVFSAVISQKPSRDICQRGTSLTIQCQVDSQVTMMFWYRQQP GQSLTLIATANQGSEATYESGFVIDKFPISRPNLTFSTLTVSNMSPEDSSIYLCSVV PWTRGGSTDTQYFGPGTRLTVLEDLKNVFPPEVAVFEPSEAEISHTQKATLVCLA TGFYPDHVELSWWNGKEVHSGVSTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVSALVLMAMVKRKDSRGGSGATNFSLLKQ AGDVEENPGPMKLVTSITVLLSLGIMGDAKTTQPNSMESNEEEPVHLPCNHSTIS GTDYIHWYRQLPSQGPEYVIHGLTSNVNNRMASLAIAEDRKSSTLIHRATLRDA AVYYCILSAHSNSGYALNFGKGTSLLVTPHIQNPDAVYQLRDSKSSDKSVCLFT DFDSQTNVSQSKDSDVYITDKTVLDMRSMDFKSNSAVAWSNKSDFACANAFNN SIIPEDTFPPSPESSCDVKLVEKSPETDTNLNFQNLSVIGFRILLLKVAGFNLLMTL RLWSS | TCR 11 Full sequence Native Homo sapiens (aa) |
| 232 | KLPQLCTEL | E6(18-26) peptide |
| 233 | TIHDIILECV | E6(29-38) peptide |
| 234 | FAFRDLCIV | E6(52-60) peptide |
| 235 | TLGIVCPI | E7(86-93) peptide |
| 236 | YMLDLQPET | E7(11-19) peptide |
| 237 | GTLGIVCPI | E7(85-93) peptide |
| 238 | LLMGTLGIV | E7(82-90) peptide |
| 239 | TLHEYMLDL | E7(7-15) peptide |
| 240 | $X_1X_2X_3X_4X_5X_6X_7$<br>$X_1$ = T, D, S, or N;<br>$X_2$ = I, or S;<br>$X_3$ = S, D, N, Y, or A;<br>$X_4$ = G, Q, P, or null;<br>$X_5$ = T, S, F, or I;<br>$X_6$ = D, Y, P, or Q;<br>$X_7$ = Y, G, N, A, S, or Q | TCR alpha E6(29-38) CDR1 consensus |
| 241 | $X_1SX_3X_4X_5X_6$<br>$X_1$ = D or V;<br>$X_3$ = S, or P;<br>$X_4$ = S or F;<br>$X_5$ = T or S;<br>$X_6$ = Y or N | TCR alpha E7(11-19) CDR1 consensus |
| 242 | MKTFAGFSFLFLWLQLDCMSRGEDVEQSLFLSVREGDSSVINCTYTDSSSTYLY WYKQDPGAGLQLLTYIFSNMDMKQDQRLTVLLNKKDKHLSLRIADTQTGDSAI YFCAVPSGATNKLIFGTGTLLAVQPNIQNPDPAVYQLRDSKSSDKSVCLFTDFDS QTNVSQSKDSDVYITDKCVLDMRSMDFKSNSAVAWSNKSDFACANAFNNSIIPE | TCR 12/ TCR 55- (E7)11 - Alpha Cysteine-modified Homo sapiens |

SEQUENCE TABLE-continued

| SEQ ID NO. | SEQUENCE | DESCRIPTION |
|---|---|---|
| 243 | DTFPPSPESSCDVKLVEKSFETDTNLNFQNLSVIGFRILLLKVAGFNLLMTLRLWS S<br>X₁X₂X₃X₄X₅X₆X₇<br>X₁ = T, D, N, S, or V;<br>X₂ = I or S;<br>X₃ = S, D, A, P, N, or Y<br>X₄ = G, Q, P, or null;<br>X₅ = T, S, I, or F;<br>X₆ = D, Y, Q, T, P, or S;<br>X₇ = Y, G, N, A, S, or Q; | TCR alpha overall CDR1 consensus (aa) |
| 244 | X₁X₂X₃X₄X₅X₆X₇X₈<br>X₁ = G, Q, I, M, Y, or V;<br>X₂ = L, S, Q, T, or Y;<br>X₃ = T, G, L, or S;<br>X₄ = Y, S, N, A, or null;<br>X₅ = null, A, or D;<br>X₆ = null, E, Q, T, or S;<br>X₇ = S, Q, R, L, or G;<br>X₈ = N, V, or E; | TCR alpha E6(29-38) CDR2 consensus |
| 245 | X₁X₂X₃X₄X₅X₆X₇<br>X₁ = I or M;<br>X₂ = F or T;<br>X₃ = S or F;<br>X₄ = N or S;<br>X₅ = M or E;<br>X₆ = D or N;<br>X₇ = M or T; | TCR alpha E7(11-19) CDR2 consensus |
| 246 | MDTWLVCWAIFSLLKAGLTEPEVTQTPSHQVTQMGQEVILRCVPISNHLYFYWY RQILGQKVEFLVSFYNNEISEKSEIFDDQPSVERPDGSNFTLKIRSTKLEDSAMYF CASTTRSSYEQYFGPGTRLTVTEDLKNVFPPEVAVFEPSEAEISHTQKATLVCLA TGFYPDHVELSWWVNGKEVHSGVSTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVSALVLMAMVKRKDSRKG | TCR 6, TCR 12 TCR 55 - (E7)11 Beta Native Homo sapiens (aa) |
| 247 | X₁X₂X₃X₄X₅X₆X₇X₈<br>X₁ = G, Q, I, V, Y, or M;<br>X₂ = L, S, Q, Y, F, or T;<br>X₃ = T, G, S, L, or F;<br>X₄ = Y, S, N, A, or null;<br>X₅ = null, A, or D;<br>X₆ = null, E, Q, S, M, or T;<br>X₇ = S, Q, R, G, D, L, or N;<br>X₈ = N, E, M, T, or V | TCR alpha overall CDR2 consensus |

| SEQ ID NO. | SEQUENCE | DESCRIPTION |
|---|---|---|
| 248 | $X_1X_2X_3X_4X_5X_6X_7X_8X_9X_{10}X_{11}X_{12}X_{13}X_{14}X_{15}X_{16}X_{17}X_{18}$<br>$X_1$ = A, I, or V;<br>$X_2$ = M, L, S, or V;<br>$X_3$ = R, L, Q, or N;<br>$X_4$ = E, V, T, P, G, or F;<br>$X_5$ = G, I, L, A, null, or P;<br>$X_6$ = R, T, G, null, or S;<br>$X_7$ = G, R, or null;<br>$X_8$ = T, G, or null;<br>$X_9$ = null or A;<br>$X_{10}$ = null or G;<br>$X_{11}$ = null or G;<br>$X_{12}$ = null or T;<br>$X_{13}$ = null or S;<br>$X_{14}$ = G, Y, null, or N;<br>$X_{15}$ = F, G, N, or T;<br>$X_{16}$ = K or N, P;<br>$X_{17}$ = T or L;<br>$X_{18}$ = I, V, F or T | TCR alpha E6(29-38) CDR3 consensus |
| 249 | $X_1X_2X_3X_4X_5X_6X_7X_8X_9X_{10}X_{11}$<br>$X_1$ = A or V;<br>$X_2$ = E or V;<br>$X_3$ = S or P<br>$X_4$ = I, S, or R;<br>$X_5$ = R, G, or D;<br>$X_6$ = G, A, or N;<br>$X_7$ = F, null, or Y;<br>$X_8$ = G or T<br>$X_9$ = N, T, or Q;<br>$X_{10}$ = V, K or N;<br>$X_{11}$ = L or F;<br>$X_{12}$ = H, I, or V | TCR alpha E7(11-19) CDR3 consensus |
| 250 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CASTTRSSYEQYFGPGTRLTVTEDLKNVPPPEVAVFEPSEAEISHTQKATLVCLA TGFYPDHVELSWWVNGKEVHSGVCTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVSALVLMAMVKRKDSRG | TCR 6, TCR 12, TCR 55-(E7)11-Beta Cysteine-modified Homo sapiens (aa) |
| 251 | $X_1X_2X_3X_4X_5X_6X_7X_8X_9X_{10}X_{11}X_{12}X_{13}X_{14}X_{15}X_{16}X_{17}X_{18}$<br>$X_1$ = A, I, or V;<br>$X_2$ = M, L, V, E, or S;<br>$X_3$ = R, L, N, Q, P, or S;<br>$X_4$ = E, V, P, T, F, I, R, G, S, or A;<br>$X_5$ = G, I, L, A, P, R, D, null, or H;<br>$X_6$ = R, T, G, S, N, null, or A; | TCR alpha overall CDR3 consensus |

SEQUENCE TABLE-continued

| SEQ ID NO. | SEQUENCE | DESCRIPTION |
|---|---|---|
| | $X_7$ = G, R, N, or null; | |
| | $X_8$ = T, G, or null; | |
| | $X_9$ = null or A; | |
| | $X_{10}$ = null or G; | |
| | $X_{11}$ = null or G; | |
| | $X_{12}$ = null or T; | |
| | $X_{13}$ = F, Y, S or null; | |
| | $X_{14}$ = G, Y, null, or N; | |
| | $X_{15}$ = F, G, T, N, Q, or Y; | |
| | $X_{16}$ = K, P, V, N or A; | |
| | $X_{17}$ = T, L, or F; | |
| | $X_{18}$ = I, V, T, H, F, or N | |
| 252 | $X_1X_2HX_3X_5$<br>$X_1$ = S or M;<br>$X_2$ = G, E, D, or N;<br>$X_3$ = V, N, or E;<br>$X_5$ = S, R, N, or Y; | TCR beta E6(29-38) CDR1 consensus |
| 253 | MLLLLVPVLEVIFTLGGTRAQSVTQLDSHVSVSEGTPVLLRCNYSSSYSPSLFWY VQHPNKGLQLLLKYTSAATLVKGINGFEAEFKKSETSFHLTKPSAHMSDAAEYF CVVRGGKLIFGQGTELSVKPNIQNPDPAVVQLRDSKSSDKSVCLFTDFDSQTNVS QSKDSDVYITDKTVLDMRSMDFKSNSAVAWSNKSDFACANAFNNSIIPEDTI-MPS PESSCDVKLVEKSFETDTNLNFQNLSVIGFRILLLKVAGFNLLMTLRLWSS | TCR 13 - Alpha Native Homo sapiens (aa) |
| 254 | $X_1X_2X_3X_4X_5$<br>$X_1$ = S or M;<br>$X_2$ = G, E, D, N, or Q;<br>$X_3$ = H or V;<br>$X_4$ = V, N, E, L, or T;<br>$X_5$ = S, R, N, Y, or M; | TCR beta overall CDR1 consensus |
| 255 | $X_1X_2X_3X_4X_5X_6$<br>$X_1$ = F or S;<br>$X_2$ = Q, Y, or V;<br>$X_3$ = N, D, or G;<br>$X_4$ = E or V;<br>$X_5$ = A, K, or G;<br>$X_6$ = Q, M, or T; | TCR beta E6(29-38) CDR2 consensus |
| 256 | MLLLLVPVLEVIFTLGGTRAQSVTQLDSHVSVSEGTPVLLRCNYSSSYSPSLFWY VQHPNKGLQLLLKYTSAATLVKGINGFEAEFKKSETSFHLTKPSAHMSDAAEYF CVVRGGKLIFGQGTELSVKPNIQNPDPAVVQLRDSKSSDKSVCLFTDFDSQTNVS QSKDSDVYITDKCVLDMRSMDFKSNSAVAWSNKSDFACANAFNNSIIPEDTFFP SPESSCDVKLVEKSFETDTNLNFQNLSVIGFRILLLKVAGFNLLMTLRLWSS | TCR 13 - Alpha Cysteine-modified Homo sapiens (aa) |
| 257 | $X_1X_2X_3GX_5X_6X_7$<br>$X_1$ = F, S, or A;<br>$X_2$ = Q, Y, V, or N; | TCR beta overall CDR2 consensus |

SEQUENCE TABLE-continued

| SEQ ID NO. | SEQUENCE | DESCRIPTION |
|---|---|---|
| | $X_3$ = N, D, G, or Q;<br>$X_5$ = E, V, N, or S;<br>$X_6$ = A, K, G, or E;<br>$X_7$ = Q, M, T, I, or A; | |
| 258 | AS $X_3X_4X_5X_6X_7X_8X_9X_{10}X_{11}X_{12}X_{13}$<br>$X_3$ = S or T<br>$X_4$ = H, P, L, F, or Y;<br>$X_5$ = L, G, W, F, T, or S;<br>$X_6$ = A, G, or L;<br>$X_7$ = G, E, A, T, Q, or null;<br>$X_8$ = F, G, T, R, or S;<br>$X_9$ = T, N, H, R, E, or A;<br>$X_{10}$ = G, T, Q, D, R, or G;<br>$X_{11}$ = E, P, T, or G;<br>$X_{12}$ = L, A, Q, or Y;<br>$X_{13}$ = F, H, Y, or T | TCR beta E6(29-38) CDR3 consensus |
| 259 | A$X_2$T$X_4$R$X_6X_7$Y$X_9X_{10}X_{11}$<br>$X_2$ = S or I;<br>$X_4$ = T or D;<br>$X_6$ = S or T;<br>$X_7$ = S or N;<br>$X_9$ = E or G;<br>$X_{10}$ = Q or Y;<br>$X_{11}$ = Y or T | TCR beta E7(11-19) CDR3 consensus |
| 260 | MGTRLLCWVLGLGTDHTGAGVSQSPRYKVAKRGQDVALRCDPISGHVSLF<br>WYQQALGQGPEFLTYFQNEAQLDKSGLPSDRFFAERPEGSVSTLKIQRTQQEDS<br>AVYLCASSPTGTERELFFGEGSRLTVLEDLKNVFPPEVAVFEPSEAEISHTQKATL<br>VCLATGFYPDHVELSWWVNGKEVHSGVSTDPQPLKEQPALNDSRYCLSSRLRV<br>SATFWQNPRNHFRCQVQFYGLSENDEWTQDRAKPVTQIVSAEAWGRADCGFTS<br>ESYQQGVLSATILYEILLGKATLYAVLVSALVLMAMVKRKDSRG | TCR 13- Beta Native *Homo sapiens* (aa) |
| 261 | $X_1X_2X_3X_4X_5X_6X_7X_8X_9X_{10}X_{11}X_{12}X_{13}X_{14}X_{15}$<br>$X_1$ = A or S;<br>$X_2$ = S, I, or V;<br>$X_3$ = S, T, or V;<br>$X_4$ = H, P, L, Y, T, D, or F;<br>$X_5$ = L, G, W, F, S, T, or R;<br>$X_6$ = A, G, L, S, or T;<br>$X_7$ = G, E, A, T, R, Q, or null;<br>$X_8$ = null or G;<br>$X_9$ = null or G;<br>$X_{10}$ = null, F, G, T, S, or R;<br>$X_{11}$ = T, N, H, A, S, R, or E;<br>$X_{12}$ = G, T, Q, D, Y, or R;<br>$X_{13}$ = E, P, T, or G; | TCR beta overall CDR3 consensus |

SEQUENCE TABLE-continued

| SEQ ID NO. | SEQUENCE | DESCRIPTION |
|---|---|---|
| | $X_{14}$ = L, A, Q, or Y;<br>$X_{15}$ = F, H, Y, or T | |
| 262 | DIQNPEPAVVQLKDPRSQDSTLCLFTDFDSQINVPKTMESGTFITDKTVLDMKAM DSKSN GAIAWSNQTS FTCQDIFKETNATYPSSDVPCDATLTEKSF ETDMNLNFQN LSVMGLRILL LKVAGFNLLM TLRLWSS | Mouse alpha constant Mus musculus (aa) |
| 263 | EDLRNVTPPKVSLFEPSKAEIANKQKATLVCLARGFFPDHVELSWWVNGKEVHS GVSTDPQAYKESNYSYCLSSRLRVSATFWHNPRNHFRCQVQFHGLSEEDKWPE GSPKPVTQNISAEAWGRADCGITSASYQQGVLSATILYEILLGKATLYAVLVS TLVVMAMVKR KNS | Mouse beta constant Mus musculus (aa) |
| 264 | MHQKRTAMFQDPQERPRKLPQLCTELQTTIHDIILECVYCKQQLLRREVYDFAF RDLCIVYRDGNPYAVCDKCLKFYSKISEYRHYCYSLYGTTLEQQYNKPLCDLLI RCINCQKPLCPEEKQRHLDKKQRFHNIRGRWTGRCMSCCRSSRTRRETQL | HPV 16 E6 (aa) |
| 265 | MHGDTPTLHEYMLDLQPETDLYCYEQLNDSSEEEDEIDGPAGQAEPDRAHYNI VTFCCKCDSTLRLCVQSTHVDIRTLEDLLMGTLGIVCPICSQKP | HPV 16 E7 (aa) |
| 266 | -PGGG-(SGGGG)$_n$-P- wherein n is 5 or 6, P is proline, G is glycine and S is serine | Linker (aa) |
| 267 | GSADDAKKDAAKKDGKS | Linker (aa) |
| 268 | ESKYGPPCPPCP | spacer (IgG4hinge) Homo sapiens (aa) |
| 269 | GAATCTAAGTACGGACCGCCCTGCCCCCCTTGCCCT | spacer (IgG4hinge) Homo sapiens (nt) |
| 270 | ESKYGPPCPPCPGQPREPQVYTLPPSQEEMTKNQVSLTCLVKGFYPSDIAVEWES NGQPENNYKTTPPVLDSDGSFFLYSRLTVDKSRWQEGNVFSCSVMHEALHNHY TQKSLSLSLGK | Hinge-CH3 spacer Homo sapiens (aa) |
| 271 | ESKYGPPCPPCPAPEFLGGPSVFLFPPKPKDTLMISRTPEVTCVVVDVSQEDPEVQ FNWYVDGVEVHNAKTKPREEQFNSTYRVVSVLTVLHQDWLNGKEYKCKVSNK GLPSSIEKTISKAKGQPREPQVYTLPPSQEEMTKNQVSLTCLVKGFYPSDIAVEW ESNGQPENNYKTTPPVLDSDGSFFLYSRLTVDKSRWQEGNVFSCSVMHEALHN HYTQKSLSLSLGK | Hinge-CH2-CH3 spacer Homo sapiens (aa) |
| 272 | RWPESPKAQASSVPTAQPQAEGSLAKATTAPATTRNTGRGGEEKKKEKEKEEQE ERETKTPECPSHTQPLGVYLLTPAVQDLWLRDKATFTCFVVGSDLKDAHLTWE VAGKVPTGGVEEGLLERHSNGSQSQHSRLTLPRSLWNAGTSVTCTLNHPSLPPQ RLMALREPAAQAPVKLSLNLLASSDPPEAASWLLCEVSGFSPPNILLMWLEDQR EVNTSGFAPARPPPQPGSTTFWAWSVLRVPAPPSPQPATYTCVVSHEDSRTLLNA SRSLEVSYVTDH | IgD-hinge-Fc Homo sapiens (aa) |

SEQUENCE TABLE-continued

| SEQ ID NO. | SEQUENCE | DESCRIPTION |
|---|---|---|
| 273 | MLLLVTSLLLCELPHPAFLLIPRKVCNGIGIGEFKDSLSINATNIKHFKNCTSISGD LHILPVAFRGDSFTHTPPLDPQELDILKTVKEITGFLLIQAWPENRTDLHAFENLEI IRGRTKQHGQFSLAVVSLNITSLGLRSLKEISDGDVIISGNKNLCYANTINWKKLF GTSGQKTKIISNRGENSCKATGQVCHALCSPEGCWGPEPRDCVSCRNVSRGREC VDKCNLLEGEPREFVENSECIQCHPECLPQAMNITCTGRGPDNCIQCAHYIDGPH CVKTCPAGVMGENNTLVWKYADAGHVCHLCHPNCTYGCTGPGLEGCPTNGPK IPSIATGMVGALLLLVALGIGLFM | tEGFR artificial (aa) |
| 274 | LEGGGEGRGSLLTCGDVEENPGPR | T2A Artificial (aa) |
| 275 | FWVLVVVGGVLACYSLLVTVAFIIFWV | CD28 (amino acids 153-179 of Accession No. P10747) Homo sapiens (aa) |
| 276 | IEVMYPPPYLDNEKSNGTIIHVKGKHLCPSPLFPGPSKP FWVLVVVGGVLACYSLLVTVAFIIFWV | CD28 (amino acids 114-179 of Accession No. P10747) Homo sapiens (aa) |
| 277 | RSKRSRLLHSDYMNMTPRRPGPTRKHYQPYAPPRDFAAYRS | CD28 (amino acids 180-220 of P10747) Homo sapiens (aa) |
| 278 | RSKRSRGGHSDYMNMTPRRPGPTRKHYQPYAPPRDFAAYRS | CD28 (LL to GG) Homo sapiens (aa) |
| 279 | KRGRKKLLYIFKQPFMRPVQTTQEEDGCSCRFPEEEGGCEL | 4-1BB (amino acids 214-255 of Q07011.1) Homo sapiens (aa) |
| 280 | RVKFSRSADAPAYQQGQNQLYNELNLGRREEYDVLDKRRGRDPEMGGKPRRK NPQEGLYN ELQKDKMAEA YSEIGMKGER RRGKGHDGLY QGLSTATKDTYDALHMQALP PR | CD3 zeta Homo sapiens (aa) |
| 281 | RVKFSRSAEPPAYQQGQNQLYNELNLGRREEYDVLDKRRGRDPEMGGKPRRKN PQEGLYNELQKDKMAEA YSEIGMKGER RRGKGHDGLY QGLSTATKDTYDALHMQALP PR | CD3 zeta Homo sapiens (aa) |

SEQUENCE TABLE-continued

| SEQ ID NO. | SEQUENCE | DESCRIPTION |
|---|---|---|
| 282 | RVKFSRSADAPAYKQGQNQLYNELNLGRREEYDVLDKRRGRDPEMGGKPRRK NPQEGLYNELQKDKMAEA YSEIGMKGER RRGKGHDGLY QGLSTATKDTYDALHMQALP PR | CD3 zeta Homo sapiens (aa) |
| 283 | GEDVEQSLFLSVREGDSSVINCTYTDSSSTYLYWYKQEPGAGLQLLTYIFSNMD MKQDQRLTVLLNKKDKHLSLRIADTQTGDSAIYFCAVPSGATNKLIFGTGTLLA VQPNIQNPDPAVYQLRDSKSSDKSVCLFTDFDSQTNVSQSKDSDVYITDKTVLD MRSMDFKSNSAVAWSNKSDFACANAFNNSIIPEDTFFPSPESSCDVKLVEKSFET DTNLNFQNLSVIGFRILLLKVAGFNLLMTLRLWSS | TCR 12/ TCR 55-(E7)11 alpha native Homo sapiens (aa) |
| 284 | GEDVEQSLFLSVREGDSSVINCTYTDSSSTYLYWYKQEPGAGLQLLTYIFSNMD MKQDQRLTVLLNKKDKHLSLRIADTQTGDSAIYFCAVPSGATNKLIFGTGTLLA VQPNIQNPDPAVYQLRDSKSSDKSVCLFTDFDSQTNVSQSKDSDVYITDKCVLD MRSMDFKSNSAVAWSNKSDFACANAFNNSIIPEDTFFPSPESSCDVKLVEKSFET DTNLNFQNLSVIGFRILLLKVAGFNLLMTLRLWSS | TCR 12/ TCR 55-(E7)11 alpha Cysteine-modified Homo sapiens (aa) |
| 285 | EPEVTQTPSHQVTQMGQEVILRCVPISNHLYFYWYRQILGQKVEFLVSFYNNEIS EKSEIFDDQFSVERPDGSNFTLKIRSTKLEDSAMYFCASTTRSSYEQYFGPGTRLT VTEDLKNVFPPEVAVFEPSEAEISHTQKATLVCLATGFYPDHVELSWWVNGKEV HSGVCTDPQPLKEQPALNDSRYCLSSRLRVSATFWQNPRNHFRCQVQFYGLSEN DEWTQDRAKPVTQIVSAEAWGRADCGFTSESYQQGVLSATILYEILLGKATLYA VLVSALVLMAMVKRKDSRG | TCR 6, TCR 12, TCR 55 - (E7)11 beta Native Homo sapiens (aa) |
| 286 | EPEVTQTPSHQVTQMGQEVILRCVPISNHLYFYWYRQILGQKVEFLVSFYNNEIS EKSEIFDDQFSVERPDGSNFTLKIRSTKLEDSAMYFCASTTRSSYEQYFGPGTRLT VTEDLKNVFPPEVAVFEPSEAEISHTQKATLVCLATGFYPDHVELSWWVNGKEV HSGVCTDPQPLKEQPALNDSRYCLSSRLRVSATFWQNPRNHFRCQVQFYGLSEN DEWTQDRAKPVTQIVSAEAWGRADCGFTSESYQQGVLSATILYEILLGKATLYA VLVSALVLMAMVKRKDSRG | TCR 6, TCR 12, TCR 55 - (E7)11 beta Cysteine-modified Homo sapiens (aa) |
| 287 | AQSVTQLDSHVSVSEGTPVLLRCNYSSSYSPSLFWYVQHPNKGLQLLLKYTSAA TLVKGINGFEAEFKKSETSPHLTKPSAHMSDAAEYFCVVRGGKLIFGQGTELSVK PNIQNPDPAVYQLRDSKSSDKSVCLFTDFDSQTNVSQSKDSDVYITDKTVLDMR SMDFKSNSAVAWSNKSDFACANAFNNSIIPEDTFFPSPESSCDVKLVEKSFETDT NLNFQNLSVIGFRILLLKVAGFNLLMTLRLWSS | TCR 13 - alpha Native Homo sapiens (aa) |
| 288 | AQSVTQLDSHVSVSEGTPVLLRCNYSSSYSPSLFWYVQHPNKGLQLLLKYTSAA TLVKGINGFEAEFKKSETSPHLTKPSAHMSDAAEYFCVVRGGKLIFGQGTELSVK PNIQNPDPAVYQLRDSKSSDKSVCLFTDFDSQTNVSQSKDSDVYITDKCVLDMR SMDFKSNSAVAWSNKSDFACANAFNNSIIPEDTFFPSPESSCDVKLVEKSFETDT NLNFQNLSVIGFRILLLKVAGFNLLMTLRLWSS | TCR 13 - alpha Cysteine-modified Homo sapiens (aa) |
| 289 | GAGVSQSPRYKVAKRGQDVALRCDPISGHVSLFWYQQALGQGPEFLTYFQNEA QLDKSGLPSDRFFAERPEGSVSTLKIQRTQQEDSAVYLCASSPTGTERELFFGEGS RLTVLEDLKNVFPPEVAVFEPSEAEISHTQKATLVCLATGFYPDHVELSWWVNG KEVHSGVSTDPQPLKEQPALNDSRYCLSSRLRVSATFWQNPRNHFRCQVQFYGL SENDEWTQDRAKPVTQIVSAEAWGRADCGFTSESYQQGVLSATILYEILLGKAT LYAVLVSALVLMAMVKRKDSRG | TCR 13 - beta native Homo sapiens |

SEQUENCE TABLE-continued

| SEQ ID NO. | SEQUENCE | DESCRIPTION |
|---|---|---|
| 290 | GAGVSQSPRYKVAKRGQDVALRCDPISGHVSLFWYQQALGQGPEFLTFQNEA QLDKSGLPSDRFFAERPEGSVSTLKIQRTQQEDSAVYLCASSPTGTEREIFFGEGS RLTVLEDLKNVFPPEVAVFEPSEAEISHTQKATLVCLATGFYPDHVELSWWVNG KEVHSGVCTDPQPLKEQPALNDSRYCLSSRLRVSATFWQNPRNHFRCQVQFYGL SENDEWTQDRAKPVTQIVSAEAWGRADCGFTSESYQQGVLSATILYEILLGKAT LYAVLVSALVLMAMVKRKDSRG | TCR 13 - beta Cysteine-modified Homo sapiens (aa) |
| 291 | ILNVEQSPQSLHVQEGDSTNFTCSFPSSNFYALHWYRWETAKSPEALFVMTLNG DEKKKGRISATLNTKEGYSVLYIKGSQPEDSATYLCASQTGANNLFFGTGTRLTV IPYIQNPDPAVYQLRDSKSSDKSVCLFTDFDSQTNVSQSKDSDVYITDKTVLDMR SMDFKSNSAVAWSNKSDFACANAFNNSIIPEDTFFPSPESSCDVKLVEKSFETDT NLNFQNLSVIGFRILLLKVAGFNLLMTLRLWSS | TCR 14 - alpha native Homo sapiens (aa) |
| 292 | ILNVEQSPQSLHVQEGDSTNFTCSFPSSNFYALHWYRWETAKSPEALFVMTLNG DEKKKGRISATLNTKEGYSVLYIKGSQPEDSATYLCASQTGANNLFFGTGTRLTV IPYIQNPDPAVYQLRDSKSSDKSVCLFTDFDSQTNVSQSKDSDVYITDKCVLDMR SMDFKSNSAVAWSNKSDFACANAFNNSIIPEDTFFPSPESSCDVKLVEKSFETDT NLNFQNLSVIGFRILLLKVAGFNLLMTLRLWSS | TCR 14 - alpha Cysteine-modified Homo sapiens (aa) |
| 293 | DVKVTQSSRYLVKRTGEKVFLECVQDMDHENMFWYRQDPGLGLRLIYFSYDV KMKEKGDIPEGYSVSREKKERFSLILESASTNQTSMYLCASTFWGQRRTEAFFGQ GTRLTVVEDLNKVFPPEVAVFEPSEAEISHTQKATLVCLATGFFPDHVELSWWV NGKEVHSGVCTDPQPLKEQPALNDSRYCLSSRLRVSATFWQNPRNHFRCQVQFY GLSENDEWTQDRAKPVTQIVSAEAWGRADCGFTSVSYQQGVLSATILYEILLGK ATLYAVLVSALVLMAMVKRKDF | TCR 14 - beta native Homo sapiens (aa) |
| 294 | DVKVTQSSRYLVKRTGEKVFLECVQDMDHENMFWYRQDPGLGLRLIYFSYDV KMKEKGDIPEGYSVSREKKERFSLILESASTNQTSMYLCASTFWGQRRTEAFFGQ GTRLTVVEDLNKVFPPEVAVFEPSEAEISHTQKATLVCLATGFFPDHVELSWWV NGKEVHSGVCTDPQPLKEQPALNDSRYCLSSRLRVSATFWQNPRNHFRCQVQF YGLSENDEWTQDRAKPVTQIVSAEAWGRADCGFTSVSYQQGVLSATILYEILLG KATLYAVLVSALVLMAMVKRKDF | TCR 14 - beta Cysteine-modified Homo sapiens (aa) |
| 295 | GEDVEQSLFLSVREGDSSVINCTYTDSSSTYLYWKQEPGAGLQLLTYIFSNMD MKQDQRLTVLLNKKDKHLSLRIADTQTGDSAIYFCAVPSGATNKLIFGTGTLLA VQP | TCR 12/ TCR 55- alpha variable Homo sapiens (aa) |
| 296 | EPEVTQTPSHQVTQMGQEVILRCVPISNHLYFYWYRQILGQKVEFLVSFYNNEIS EKSEIFDDQFSVERPDGSNFTLKIRSTKLEDSAMYFCASTTRSSYEQYFGPGTRLT VT | TCR 6, TCR 12, TCR 55 - beta variable Homo sapiens (aa) |
| 297 | AQSVTQLDSHVSVSEGTPVLLRCNYSSSYSPSLFWYVQHPNKGLQLLLKYTSAA TLVKGINGFEAEFKKSETSFHLTKPSAHMSDAAEYFCVVRGGKLIFGQGTELSVK P | TCR 13 - alpha variable Homo sapiens (aa) |

SEQUENCE TABLE-continued

| SEQ ID NO. | SEQUENCE | DESCRIPTION |
|---|---|---|
| 298 | GAGVSQSPRYKVAKRGQDVALRCDPISGHVSLFWYQQALGQGPEFLTYFQNEA QLDKSGLPSDRFFAERPEGSVSTLKIQRTQQEDSAVYLCASSPTGTERELFFGEGS RLTVL | TCR 13 - beta variable Homo sapiens (aa) |
| 299 | ILNVEQSPQSLHVQEGDSTNFTCSFPSSNFYALHWYRWETAKSPEALFVMTLNG DEKKKGRISATLNTKEGYSYLYIKGSQPEDSATYLCASQTGANNLFFGTGTRLTV IP | TCR 14 - alpha variable Homo sapiens (aa) |
| 300 | DVKVTQSSRYLVKRTGEKVFLECVQDMDHENMFWYRQDPGLGLRLIYFSYDV KMKEKGDIPEGYSVSREKKERFSLILESASTNQTSMYLCASTFWGQRRTEAFFGQ GTRLTVV | TCR 14 - beta variable Homo sapiens (aa) |
| 301 | AVPSGATNKLI | TCR 12/ TCR 55 CDR3 alpha Homo sapiens (aa) |
| 302 | SSYSPS | TCR 13 CDR1 alpha Homo sapiens (aa) |
| 303 | YTSAATLV | TCR 13 CDR2 alpha Homo sapiens (aa) |
| 304 | VVRGGKLI | TCR 13 CDR3 alpha Homo sapiens (aa) |
| 305 | ASSPTGTERELF | TCR 13 CDR3 alpha Homo sapiens (aa) |
| 306 | SSNFYA | TCR 14 CDR1 alpha Homo sapiens (aa) |
| 307 | MTLNGDE | TCR 14 CDR2 alpha Homo sapiens (aa) |

SEQUENCE TABLE-continued

| SEQ ID NO. | SEQUENCE | DESCRIPTION |
|---|---|---|
| 308 | ASQTGANNLF | TCR 14 CDR3 alpha Homo sapiens (aa) |
| 309 | ASTFWGQRRTEAF | TCR 14 CDR3 beta Homo sapiens (aa) |
| 310 | MLLLIVPVLEVIFTLGGTR | TCR 13 alpha signal sequence Homo sapiens (aa) |
| 311 | MEKNPLAAPLLILMFHLDCVSS | TCR 14 alpha signal sequence Homo sapiens (aa) |
| 312 | MGTRLLCWVLGFLGTDHTGAGVSQSPRYKVAKRGQDVALRCDPISGHVSLF WYQQALGQGPEFLTYFQNEAQLDKSGLPSDRFFAERPEGSVSTLKIQRTQQEDS AVYLCASSPTGTERELFFGEGSRLTVLEDLKNVFPPEVAVFEPSEAEISHTQKATL VCLATGFYPDHVELSWWVNGKEVHSGVCTDPQPLKEQPALNDSRYCLSSRLRV SATFWQNPRNHFRCQVQFYGLSENDEWTQDRAKPVTQIVSAEAWGRADCGFTS ESYQQGVLSATILYEILLGKATLYAVLVSALVLMAMVKRKDSRG | TCR 13 - Beta Cysteine-modified Homo sapiens (aa) |
| 313 | MEKNPLAAPLLILMFHLDCVSSILNVEQSPQSLHVQEGDSTNFTCSFPSSNFYAL HWYRWETAKSPEALFVMTLNGDEKKGRISATLNTKEGYSYLYIKGSQPEDSA TYLCASQTGANNLFFGTGTRLTVIPYIQNPDPAVYQLRDSKSSDKSVCLFTDFDS QTNVSQSKDSDVYITDKTVLDMRSMDFKSNSAVAWSNKSDFACANAFNNSIIPE DTFFPSPESSCDVKLVEKSFETDTNLNFQNLSVIGFRILLLKVAGFNLLMTLRLWS S | TCR 14 - Alpha Native Homo sapiens (aa) |
| 314 | MEKNPLAAPLLILMFHLDCVSSILNVEQSPQSLHVQEGDSTNFTCSFPSSNFYAL HWYRWETAKSPEALFVMTLNGDEKKGRISATLNTKEGYSYLYIKGSQPEDSA TYLCASQTGANNLFFGTGTRLTVIPYIQNPDPAVYQLRDSKSSDKSVCLFTDFDS QTNVSQSKDSDVYITDKCVLDMRSMDFKSNSAVAWSNKSDFACANAFNNSIIPE DTFFPSPESSCDVKLVEKSFETDTNLNFQNLSVIGFRILLLKVAGFNLLMTLRLWS S | TCR 14 - Alpha Cysteine-modified Homo sapiens (aa) |
| 315 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLILESASTNQTSM YLCASTFWGQRRTEAFFGQGTRLTVVEDLNKVFPPEVAVFEPSEAEISHTQKATL VCLATGFFPDHVELSWWVNGKEVHSGVSTDPQPLKEQPALNDSRYCLSSRLRVS ATFWQNPRNHFRCQVQFYGLSENDEWTQDRAKPVTQIVSAEAWGRADCGFTS VSYQQGVLSATILYEILLGKATLYAVLVLMAMVKRKDF | TCR 14 - Beta Native Homo sapiens (aa) |

SEQUENCE TABLE-continued

| SEQ ID NO. | SEQUENCE | DESCRIPTION |
|---|---|---|
| 316 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLILESASTNQTSM YLCASTFWGQRRTEAFFGQGTRLTVEDLNKVFPPEVAVFEPSEAEISHTQKATL VCLATGFFPDHVELSWWVNGKEVHSGVCTDPQPLKEQPALNDSRYCLSSRLRV SATFWQNPRNHFRCQVQFYGLSENDEWTQDRAKPVTQIVSAEAWGRADCGFTS VSYQQGVLSATLYEILLGKATLYAVLVSALVLMAMVKRKDF | TCR 14 – Beta Cysteine-modified Homo sapiens (aa) |
| 317 | NIQNPEPAVVQLKDPRSQDSTLCLFTDFDSQINVPKTMESGTFITDKTVLDMKAM DSKSNGAIAWSNQTSFTCQDIFKETNATYPSSDVPCDATLTEKSFETDMNLNFQN LSVMGLRILLLKVAGFNLLMTLRLWSS | Mouse Alpha Constant Sequence Mus musculus (aa) |
| 318 | MSLSSLLKVVTASLWLGPGIAQKITQTQPGMFVQEKEAVTLDCTYDTSDQSYGL FWYKQPSSGEMIFLIYQGSYDEQNATEGRYSLNFQKARKSANLVISASQLGDSA MYFCAMREGRGFKTIFGAGTRLFVKANIQKPDPAVYQLRDSKSSDKSVCLFTDF DSQTNVSQSKDSDVYITDKTVLDMRSMDFKSNSAVAWSNKSDFACANAFNNSII PADTFFPSPESSCDVKLVEKSFETDTNLNFQNLSVIGFRILLLKVAGFNLLMTLRL WSS | TCR 3 – Alpha Native Homo sapiens (aa) |
| 319 | MSLSSLLKVVTASLWLGPGIAQKITQTQPGMFVQEKEAVTLDCTYDTSDQSYGL FWYKQPSSGEMIFLIYQGSYDEQNATEGRYSLNFQKARKSANLVISASQLGDSA MYFCAMREGRGFKTIFGAGTRLFVKANIQKPDPAVYQLRDSKSSDKSVCLFTDF DSQTNVSQSKDSDVYITDKCVLDMRSMDFKSNSAVAWSNKSDFACANAFNNSII PADTFFPSPSSSCDVKLVEKSFETDTNLNFQNLSVIGFRILLLKVAGFNLLMTLRL WSS | TCR 3 – Alpha Cysteine-modified Homo sapiens (aa) |
| 320 | MGTRLLCWVVLGFLGTDHTGAGVSQSPRYKVAKRGQDVALRCDPISGHVSLF WYQQALGQGPEFLTYFQNEAQLDKSGLPSDRFFAERPEGSVSTLKIQRTQEDS AVYLCASSHLAGFTGELFFGEGSRLTVLEDLKNVFPPEVAVFEPSEAEISHTQKA TLVCLATGFYPDHVELSWWVNGKEVHSGVSTDPQPLKEQPALNDSRYCLSSRL RVSATFWQNPRNHFRCQVQFYGLSENDEWTQDRAKPVTQIVSARAWGRADCG FTSESYQQGVLSATIYEILLGKATLYAVLVSALVLMAMVKRKDSRG | TCR 3 – Beta Native Homo sapiens (aa) |
| 321 | MGTRLLCWVVLGFLGTDHTGAGVSQSPRYKVAKRGQDVALRCDPISGHVSLF WYQQALGQGPEFLTYFQNEAQLDKSGLPSDRFFAERPEGSVSTLKIQRTQEDS AVYLCASSHLAGFTGELFFGEGSRLTVLEDLKNVFPPEVAVFEPSEAEISHTQKA TLVCLATGFYPDHVELSWWVNGKEVHSGVCTDPQPLKEQPALNDSRYCLSSRL RVSATFWQNPRNHFRCQVQFYGLSENDEWTQDRAKPVTQIVSARAWGRADCG FTSESYQQGVLSATIYEILLGKATLYAVLVSALVLMAMVKRKDSRG | TCR 3 – Beta Cysteine-modified Homo sapiens (aa) |
| 322 | MKLVTSITVLLSLGIMGDAKTTQPNSMESNEEEPVHLPCNHSTISGTDYIHWYRQ LPSQGPEYVIHGLTSNVNNRMASLAIAEDRKSSTLILHRATLRDAAVYYCILLVIR GTSYGKLTFGQGTILTVHPNIQNPDPAVYQLRDSKSSDKSVCLFTDFDSQTNVSQ SKDSDVYITDKTVLDMRSMDFKSNSAVAWSNKSDFACANAFNNSIIPEDTFFPSP ESSCDVKLVEKSFETDTNLNFQNLSVIGFRILLLKVAGFNLLMTLRLWSS | TCR 4 – (E6)29 alpha Native Homo sapiens (aa) |
| 323 | MKLVTSITVLLSLGIMGDAKTTQPNSMESNEEEPVHLPCNHSTISGTDYIHWYRQ LPSQGPEYVIHGLTSNVNNRMASLAIAEDRKSSTLILHRATLRDAAVYYCILLVIR GTSYGKLTFGQGTILTVHPNIQNPDPAVYQLRDSKSSDKSVCLFTDFDSQTNVSQ | TCR 4 – (E6)29 alpha Cysteine-modified Homo sapiens |

SEQUENCE TABLE-continued

| SEQ ID NO. | SEQUENCE | DESCRIPTION |
|---|---|---|
| | SKDSDVYITDKCVLDMRSMDFKSNSAVAWSNKSDFACANAFNNSIIPEDTFFPSP ESSCDVKLVEKSFETDTNLNFQNLSVIGFRILLLKVAGFNLLMTLRLWSS | |
| 324 | MGTSLLCWMALCLLGADHADTGVSQDPRHKITKRGQNVTFRCDPISEHNRLYW YRQTLGQGPEFLTYFQNEAQLEKSRLLSDRFSAERPKGSFSTLEIQRTEQGDSAM YLCASSPGGGNTEAFFGQGTRLTVVEDLNKVFPPEVAVFEPSEAEISHTQKATLV CLATGFFPDHVELSWWVNGKEVHSGVSTDPQPLKEQPALNDSRYCLSSRLRVSA TFWQNPRNHFRCQVQFYGLSENDEWTQDRAKPVTQIVSARAWGRADCGFTSVS YQQGVLSATILYEILLGKATLYAVLVSALVLMAMVKRKDF | TCR 4 - (E6)29 Beta Native Homo sapiens (aa) |
| 325 | MGTSLLCWMALCLLGADHADTGVSQDPRHKITKRGQNVTFRCDPISEHNRLYW YRQTLGQGPEFLTYFQNEAQLEKSRLLSDRFSAERPKGSFSTLEIQRTEQGDSAM YLCASSPGGGNTEAFFGQGTRLTVVEDLNKVFPPEVAVFEPSEAEISHTQKATLV CLATGFFPDHVELSWWVNGKEVHSGVCTDPQPLKEQPALNDSRYCLSSRLRVS ATFWQNPRNHFRCQVQFYGLSENDEWTQDRAKPVTQIVSAEAWGRADCGFTS VSYQQGVLSATILYEILLGKATLYAVLVSALVLMAMVKRKDF | TCR 4 - (E6)29 Beta Cysteine-modified Homo sapiens (aa) |
| 326 | MSLSSLLKVVTASLWLGPGIAQKITQTQPGMFVQEKEAVTLDCTYDTSDQSYGL FWYKQPSSGEMIFLIYQGSYDEQNATEGRYSLNFQKARKSANLVISASQLGDSA MYFCAMREGTSYGKLTFGQGTILTVHPNIQNPDPAVYQLRDSKSSDKSVCLF TDFDSQTNVSQSKDSDVYITDKTVLDMRSMDFKSNSAVAWSNKSDFACANAFN NSIIPEDTFFPSPESSCDVKLVEKSFETDTNLNFQNLSVIGFRILLLKVAGFNLLMT LRLWSS | TCR 5 - (E6)29 - TCR alpha Native Homo sapiens (aa) |
| 327 | MSLSSLLKVVTASLWLGPGIAQKITQTQPGMFVQEKEAVTLDCTYDTSDQSYGL FWYKQPSSGEMIFLIYQGSYDEQNATEGRYSLNFQKARKSANLVISASQLGDSA MYFCAMREGTSYGKLTFGQGTILTVHPNIQNPDAVYQLRDSKSSDKSVCLF TDFDSQTNVSQSKDSDVYITDKCVLDMRSMDFKSNSAVAWSNKSDFACANAFN NSIIPEDTFFPSPESSCDVKLVEKSFETDTNLNFQNLSVIGFRILLLKVAGFNLLMT LRLWSS | TCR 5 - (E6)29 - TCR alpha Cysteine-modified Homo sapiens (aa) |
| 328 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLILESASTNQTSM YLCASSPWGETHQPQHFGDGTRLSILEDLNKVFPPEVAVFEPSEAEISHTQKATL VCLATGFFPDHVELSWWVNGKEVHSGVSTDPQPLKEQPALNDSRYCLSSRLRVS ATFWQNPRNHFRCQVQFYGLSENDEWTQDRAKPVTQIVSAEAWGRADCGFTS VSYQQGVLSATILYEILLGKATLYAVLVSALVLMAMVKRKDF | TCR 5 - (E6)29 - TCR beta Native Homo sapiens (aa) |
| 329 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLILESASTNQTSM YLCASSPWGETHQPQHFGDGTRLSILEDLNKVFPPEVAVFEPSEAEISHTQKATL VCLATGFFPDHVELSWWVNGKEVHSGVCTDPQPLKEQPALNDSRYCLSSRLRV SATFWQNPRNHFRCQVQFYGLSENDEWTQDRAKPVTQIVSAEAWGRADCGFTS VSYQQGVLSATILYEILLGKATLYAVLVSALVLMAMVKRKDF | TCR 5 - (E6)29 - TCR beta Cysteine-modified Homo sapiens (aa) |
| 330 | MKTFAGFSFLFLWLQLDCMSRGEDVEQSLFLSVREGDSSVINCTYTDSSSTYLY WYKQEPGAGLQLLTYIFSNMDMKQDQRLTVLLNKKDKHLSLRIADTQTGDSAI YFCAESIRGPGNVLHCGSGTQVIVLPHIQNPDPAVYQLRDSKSSDKSVCLFTDFD SQTNVSQSKDSDVYITDKTVLDMRSMDFKSNSAVAWSNKSDFACANAFNNSIIP | TCR 6 - Alpha Native Homo sapiens (aa) |

SEQUENCE TABLE-continued

| SEQ ID NO. | SEQUENCE | DESCRIPTION |
|---|---|---|
| | EDTFFPSPESSCDVKLVEKSFETDTNLNFQNLSVIGFRILLLKVAGFNLLMTLRLW SS | TCR 6 - Alpha Cysteine-modified Homo sapiens (aa) |
| 331 | MKTFAGFSFLFLWLQLDCMSRGEDVEQSLFLSVREGDSSVINCTYTDSSSTYLY WYKQEPGAGLQLLTYIFSNMDKQDQRLTVLLNKKDKHLSLRIADTQTGDSAI YFCAESIRGFNVLHCGSGTQVIVLPHIQNPDPAVYQLRDSKSSDKSVCLFTDFD SQTNVSQSKDSDVYITDKCVLDMRSMDFKSNSAVAWSNKSDFACANAFNNSIIP EDTFFPSPESSCDVKLVEKSFETDTNLNFQNLSVIGFRILLLKVAGFNLLMTLRLW SS | TCR 6, TCR 12 - Beta Native Homo sapiens (aa) |
| 332 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CASTTRSSYEQYFGPGTRLTVTEDLKNVFPPEVAVFEPSEAEISHTQKATLVCLA TGFYPDHVELSWWVNGKEVHSGVSTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVSALVLMAMVKRKDSRG | TCR 6, TCR 12 - Beta Cysteine-modified Homo sapiens (aa) |
| 333 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CASTTRSSYEQYFGPGTRLTVTEDLKNVFPPEVAVFEPSEAEISHTQKATLVCLA TGFYPDHVELSWWVNGKEVHSGVCTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVSALVLMAMVKRKDSRG | TCR 7/ TCR 54 - (E7)11 - alpha Native Homo sapiens (aa) |
| 334 | MKKHLTTFLVILWLYFYRGNGKNQVEQSPQSLIILEGKNCTLQCNYTVSPFSNLR WYKQDTGRGPVSLTIMTFSENTKSNGRYTATLDADTKQSSLHITASQLSDSASYI CVVSRDNYGQNFVFGPGTRLSVLPYIQNPDPAVYQLRDSKSSDKSVCLFTDFDS QTNVSQSKDSDVYITDKCVLDMRSMDFKSNSAVAWSNKSDFACANAFNNSIIPE DTFFPSPESSCDVKLVEKSFETDTNLNFQNLSVIGFRILLLKVAGFNLLMTLRLWS | TCR 7/ TCR 54 - (E7)11 - alpha Cysteine-modified Homo sapiens (aa) |
| 335 | MKKHLTTFLVILWLYFYRGNGKNQVEQSPQSLIILEGKNCTLQCNYTVSPFSNLR WYKQDTGRGPVSLTIMTFSENTKSNGRYTATLDADTKQSSLHITASQLSDSASYI CVVSRDNYGQNFVFGPGTRLSVLPYIQNPDPAVYQLRDSKSSDKSVCLFTDFDS QTNVSQSKDSDVYITDKCVLDMRSMDFKSNSAVAWSNKSDFACANAFNNSIIPE DTFFPSPESSCDVKLVEKSFETDTNLNFQNLSVIGFRILLLKVAGFNLLMTLRLWS | TCR 7/ TCR 54 -Beta Native Homo sapiens (aa) |
| 336 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CAITDRTNYGYTFGSGTRLTVVEDLNKVFPPEVAVFEPSEAEISHTQKATLVCLA TGFFPDHVELSWWVNGKEVHSGVSTDPQPLKEQPALNDSRYCLSSRLRVSATF WQNPRNHFRCQVQFYGLSENDEWTQDRAKPVTQIVSAEAWGRADCGFTSVSY QQGVLSATILYEILLGKATLYAVLVSALVLMAMVKRKDF | TCR 7/ TCR 54 -Beta Cysteine-modified Homo sapiens |
| 337 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CAITDRTNYGYTFGSGTRLTVVEDLNKVFPPEVAVFEPSEAEISHTQKATLVCLA TGFFPDHVELSWWVNGKEVHSGVCTDPQPLKEQPALNDSRYCLSSRLRVSATF | |

SEQUENCE TABLE-continued

| SEQ ID NO. | SEQUENCE | DESCRIPTION |
|---|---|---|
| | WQNPRNHFRCQVQFYGLSENDEWTQDRAKPVTQIVSAEAWGRADCGFTSVSY QQGVLSATILYEILLGKATLYAVLVSALVLMAMVKRKDF | (aa) |
| 338 | METLLGLLIIWLQLQWVSSKQEVTQIPAALSVPEGENLVLNCSFTDSAIYNLQW FRQDPGKGLTSLLLIQSSQREQTSGRLNASLDKSSGRSTLYIAASQPGDSATYLCA VRPLGNTPLVFGKGTRLSVIANIQNPDPAVYQLRDSKSSDKSVCLFTDFDSQTNV SQSKDSDVYITDKTVLDMRSMDFKSNSAVAWSNKSDFACANAFNNSIIPEDTFFP SPESSCDVKLVEKSFETDTNLNFQNLSVIGFRILLLKVAGFNLLMTLRLWSS | TCR 8 - Alpha Native Homo sapiens (aa) |
| 339 | METLLGLLIIWLQLQWVSSKQEVTQIPAALSVPEGENLVLNCSFTDSAIYNLQW FRQDPGKGLTSLLLIQSSQREQTSGRLNASLDKSSGRSTLYIAASQPGDSATYLCA VRPLGNTPLVFGKGTRLSVIANIQNPDPAVYQLRDSKSSDKSVCLFTDFDSQTNV SQSKDSDVYITDKCVLDMRSMDFKSNSAVAWSNKSDFACANAFNNSIIPEDTFF PSPESSCDVKLVEKSFETDTNLNFQNLSVIGFRILLLKVAGFNLLMTLRLWSS | TCR 8 - Alpha Cysteine-modified Homo sapiens (aa) |
| 340 | MDTWLVCWAIFSLLKAGLITEPEVTQTPSHQVTQMGQEVILRCVPISNHLYFYWY RQILGQKVEFLVSFYNNEISEKSEIFDDQFSVERPDGSNFTLKIRSTKLEDSAMYF CASTTRSSYEQYFGPGTRLTVTEDLKNVFPPEVAVFEPSEAEISHTQKATLVCLA TGFYPDHVELSWWVNGKEVHSGVSTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVSALVLMAMVKRKDSRGGSGATNFSLLKQ AGDVEENPGPMKTFAGFSFLFLWLQLDCMSRGEDVEQSLFPLSVREGDSSVINCT YTDSSSTYLYWYKQEPGAGLQLLTYIFSNMDMKQDQRLITVLLNKKDKHLSLRI ADTQTGDSAIYFCAVPSGATNKLIFGTGTLLAVQPNIQNPDPAVYQLRDSKSSDK SVCLFTDFDSQTNVSQSKDSDVYITDKTVLDMRSMDFKSNSAVAWSNKSDFAC ANAFNNSIIPEDTFFPSPESSCDVKLVEKSFETDTNLNFQNLSVIGFRILLLKVAGF NLLMTLRLWSS | TCR 12/ TCR 55 Full sequence Native Homo sapiens (aa) |
| 341 | MGTRLLCWVVLGFLGTDHTGAGVSQSPRYKVAKRGQDVALRCDPISGHVSLF WYQQALGQGPEFLTYFQNEAQLDKSGLPSDRFFAERPEGSVSTLKIQRTQQEDS AVYLCASSPTGTERELFFGEGSRLTVLEDLKNVFPPEVAVFEPSEAEISHTQKATL VCLATGFYPDHVELSWWVNGKEVHSGVSTDPQPLKEQPALNDSRYCLSSRLRV SATFWQNPRNHFRCQVQFYGLSENDEWTQDRAKPVTQIVSAEAWGRADCGFTS ESYQQGVLSATILYEILLGKATLYAVLVSALVLMAMVKRKDSRGGSGATNFSLL KQAGDVEENPGPMLLLLVPVLEVIFTLGGTRAQSVTQLDSHVSVSEGTPVLLRC NYSSSYSPSLFWYVQHPNKGLQLLLKYTSAATLVKGINGPEAEPKKSETSFHLTK PSAHMSDAAEYFCVVRGGKLIFGQGTELSVKPNIQNPDPAVYQLRDSKSSDKSV CLFTDFDSQTNVSQSKDSDVYITDKTVLDMRSMDFKSNSAVAWSNKSDFACAN AFNNSIIPEDTFFPSPESSCDVKLVEKSFETDTNLNFQNLSVIGFRILLLKVAGFNL LMTLRLWSS | TCR 13 Full sequence Native Homo sapiens (aa) |
| 342 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLILESASTNQTSM YLCASTFWGQRRTEAFFGQGTRLTVVEDLNKVFPPEVAVFEPSEAEISHTQKATL VCLATGFYPDHVELSWWVNGKEVHSGVSTDPQPLKEQPALNDSRYCLSSRLRVS ATFWQNPRNHFRCQVQFYGLSENDEWTQDRAKPVTQIVSAEAWGRADCGFTS VSYQQGVLSATILYEILLGKATLYAVLVSALVLMAMVKRKDFGSSGATNFSLLKQ AGDVEENPGPMEKNPLAAPLLILMFHLDCVSSILNVEQSPQSLHVQEGDSTNFTC SFPSSNFYALHWYRWETAKSPEALFVMTLNGDEKKKGRISATLNTKEGYSLYI | TCR 14 Full sequence Native Homo sapiens (aa) |

SEQUENCE TABLE-continued

| SEQ ID NO. | SEQUENCE | DESCRIPTION |
|---|---|---|
|  | KGSQPEDSATYLCASQTGANNLFGTGTRLTVIPYIQNPDPAVVQLRDSKSSDKS VCLFTDFDSQTNVSQSKDSDVYITDKTVLDMRSMDFKSNSAVAWSNKSDFACA NAFNNSIIPEDTFFPSPESSCDVKLVEKSFETDTNLNFQMLSVIGFRILLKVAGFN LLMTLRLWSS | tEGFR artificial |
| 343 | RKVCNGIGIGEFKDSLSINATNIKHFKNCTSISGDLHILPVAFRGDSFTHTPPLDPQ ELDILKTVKEITGFLLIQAWPENRTDLHAFENLEIIRGRTKQHGQFSLAVVSLNITS LGLRSLKEISDGDVIISGNKNLCYANTINWKKLFGTSGQKTKIISNRGENSCKATG QVCHALCSPEGCWGPEPRDCVSCRNVSRGRECVDKCNLLEGEPREFVENSECIQ CHPECLPQAMNITCTGRGPDNCIQCAHYIDGPHCVKTCPAGVMGENNTLVWKY ADAGHVCHLCHPNCTYGCTGPGLEGCPTNGPKIPSIATGMVGALLLLVVALGI GLFM |  |
| 344 | VKQTLNFDLLKLAGDVESNPGP | F2A |
| 345 | ATNFSLLKQAGDVEENPGP | P2A |
| 346 | QCTNYALLKLAGDVESNPGP | E2A |
| 347 | ggaagcgggcgccacaaacttctcactgctgaaacaggccggcgacgtggaggagaatcctggccca | TCR 49/ TCR 51/ TCR 52/ TCR 53/ TCR 55 - P2A Artificial (nt) |
| 348 | atatccagaacccgtgaccctgccgtgtaccagtcgagagactctaaatccagtgacaagtctgtctgcctattcaccgatttgatt ctcaacaaatgtgtcacaaagtaaggatctgatgtgtatatcagacaaaactgtgctagacatgaggtctatgacttcaag agcaacagtgctgtggcctggagcaacaaatctgacttgcatgtgcaggcgcttcaacaaacagcattattccagaagacacct tcttcccagccagtaagggcagcttggtgcctcactgacgggctcaccatgagaatacgccaggtctgcccagagctc tggtcaatgatgtctaaaactccctgattggtgctcggccttatcattgccaccaaaacctcttttactaagaaacagtgag cctgttcctggcagtcccagagaatgacacggaaaaaacagatgaagaagcagttgccccttactgcttcttcaggcctcattctaagccctt ctccaagttgcctctcctattctccccgctctgccaaaaatcttcccagtcctcacgcagtcactcattaaccc accaatcactgattgtgccggcacatgaatgcccaggtgaagtgaagaatcaaataacttcagattgaatgttttaactcagg aggagcaccattcagttgggaggagccatctgtcagtcggagaaggtcctctgagcatcaggacacaaagtcacttaccaa gttgagaaaacagtcacctcaggaccataagccctaatgagaaggagcagagagcccagcagcatgagtgaatga aggggcaggggccggtcacaaggccttcaagggcatgagaggggagagacagtattctaaggacgccagaaagctcgttgatcg gctccaagcaggggaggggacaccattgcttcttttttttttcaaggatgcagttgctgtctgtgcccaggct ggagtgcaatggtgcatctggcccaacctcccgccttcactcgaaccctcagccttgcccaggctgctg agattacaggcaccccgccaccatgcctgctaattttttagtagagacagggtttcactatgttggccagcctggtctcg aactctgacctcaggtgatccaccccgctcagcctccccaaagtgctgggattacaggcgtgagccaccaccccgctgctt ttcttaaagatcaatctgagtgctgaaggctcagggtggtgcaggaggtaaccaccatccaagtttcaagtagaaccatgcaggatg agaatgatgaggcctggcagggtgctgcaggactgctgattttgcctgagcagctgagtcaagagtgccgttctactaaggaag aaccaaggacaaagggagggatcaaaacttttggaacatatgaaggtgtttatactcttttatggcctgtcact atgatgccgcctgcttgctactttgtacaaacagtgtatattgctgaagtcccctgcaggtaaatagaacactgaactctccacaaggctgctgcaggcctccccaaggc tcatgcaacatgtactttgagcaggtgccatatgctgaagtcccctgcaggtctctcacaaggggcagaggagggtatcgtccaggc caggggctctccctagcaggtgcctcattgactctagaatgaaccaaggctccaggagccgaggtatggtcctgccagggc acctgccaagaactgaggagtctgggggttggagaggtcagcctgtcgatgctgaagatgcttttcctttaagaaagt |  Human TCR alpha constant (TRAC) NCBI Reference Sequence: NG_001332.3, TRAC |

SEQUENCE TABLE-continued

| SEQ ID NO. | SEQUENCE | DESCRIPTION |
|---|---|---|
|  | tcctgtgatgtcaagctggtcgagaaagctttgaaacaggtaagacagggtctagcctgggttgcacaggatgcggaagt<br>gatgaaccgcaataaccctgcctgatgaggagtgggaagaaattagtagatgtggaagaatgaatgatgaggatggaaac<br>agcggttcaagaccgcggcagagctggtgggtggggtctctccgaatcctcctgactctcctaagcacttttgagg<br>atgagttcagttcaatagacaccaagagactctctcctaggcctctgtattccttcaacagtccactgtcaagagagcagagag<br>agcttctgggtggccagtgtgaaattctcagacacagtactcacacaggctgcccctaggatagccaccagacatcctgaggacagccaag<br>aggtttgccttctttcaagacaagtcactcatttctgagtgttcttattgagtcctcctcctgtagcggaactcactaaggggcc<br>cacaccccactggccccattcattcattccacacaatactgtgatgataaattcgagcaaccaatcccccagaaggctcagaaatcgtttgtaaggggatatgcacagaa<br>catctggaccggtgttcctgcttgaaacacaatactgtgccctgcccaccagcctgctctgggaaaacgtgggtgtgtc<br>gctcaaggagacaggaggtcaggcctgccagaacatgcaagccctaaccgtgtttacagatacgaagcctaaacttcaaa<br>ctgcagccatgcagctgtcgaagccataaaaccgctgggtttaatctgcctcatgacgtgcgtggtcagtccagtag<br>cctgcagtgattgggtccgaattcctcctgaaagtggccgggtctctggtgcatccctaagcctgaagctgagagcaactccctgc<br>gtgaggggcctgaagctggaagctggggtaggagacgggggtctaggtggggtccaaactctccttctacaaatctccttgcaataatggcc<br>agggcctgtcgttaagtccaagcctgagcccaccagcctctccccctgaggtgcactctccctatgaggtaggaacagttgttagaaacgaag<br>tgaaactgcttaaatatccattcaggcctgtccactcctcctatgaggcaggagaacagttgttagaaacgaag<br>aaactgaggccccagctaatgagtggaggaagagacacttgtgtacaccacatgcctgtgttgtacttctcacgtgt<br>aacctcctcatgtctctcctccccctccccaggtccccagtgctcttagctcagtcagtagaaagaaagacattacactccatattaccaatcctggc<br>tagaggctggtgcggggctcacacctgtaatcccagcccctaatcacagcactttgggaggccgaggcggcaggactcacctgaggtcaggagt<br>cggggcaacacagggagaccccgcctctacaaaagtgaaaaattaaccaggtgtgtgtgcaaggcaggagcggagacc<br>gctactaagaggctgagatgggaggctcgttgagcctgagcggcgtgagtgtgaggctacaatgagtgtcactctgctcactcc<br>agcctggagacaaagcaagatctgtctcaaataataaacaaggttagcctggctacattgtcctgaactctaccac<br>atagcccccaaacagcccatcactcacatcctaacagtcgtctcctggtctccagtgcccagctcctgacttctgtttcctcattc<br>cagatctgcaagattgtaagacagctgtgctcctccaatgccctgccaatgcaatccccggcaatgccaactggattcatggaaggggaact<br>ctcctacccccaaggaggtgaaagtgcaaacactgctgtaccacactgctgcacccctctgtccctctgtgcctgctgcatcacgatgag<br>attaagatgtgcgaagaggtgcagctgctgagcctccttgcatcctcctcctccttgctgcctccagcatccccacagatgatgg<br>aggaaggtgctgcagcctcgaccgtgggtcttctggcctgaggtttatttttttaatagtgtctaaagaaatacatag<br>atcttcagtgggttctctcaagacgtggggggaaattatctcattatcgaggccctgctatcgctgtatcgggcgtgtgtatgtcctgtgcc<br>gatgccttc |  |
| 349 | aggacctgaacaagtgttccacccgagtgcgctgtgtttgagccatcagaagcagagatctcccaccaaaaggccaca<br>ctggtgtgcctggccacaggcttcttcccccgaccagtgaccgtgagctggtgggtggaatggaaggagtgcacagtggggg<br>tcacgacagacccagccgccctcaaggagcagcccggcaactactgcctgcagcagcctgaggctctc<br>ggccacctccggcagaaccccctgcagctcgctgtgcaagtccagttctacgggctctcggagaatgactccggggaatgc<br>aggatgagcgggcaaaccgtcaacccgctggtgctgctgagagcagtagagaagaagcagcagagccaagagcagct<br>ctgagcagagattaggtgagcagccatgtgtggagaccaccgaagctgttgcttctctctccagatgctgctgcacatgctggattgcaa<br>gggcccccttctatgtggcctgtgtaatctcatcctggttgccccccagtgctgccacagccaagagcagctggagctg<br>tgccaactgagtgcccagcttaatgtgcctatgaaaataaggtcctcattattttctcctgcttctttcagactgtggct<br>ttacctcgggtaggtgaattgcagacttacttctctttccttctcctcatggttcttgaccagaacaaggatgaagactaccacact<br>gcagggtggaggggtggcagagccagaaggaagctgcacaggtccactgctgttgctctaggagaactcatgacatctcacca<br>gcaagtgtcctgtgccgaacctactcctgtgccaggtcacaggttcatcagctgcaaagtaacctgcacctcgt<br>agagtcccctgccaggattgggtgctggaagggggcagggaggaacttcattcaggtgcctgcaagtaacctgcacctctgt<br>aggatcacagtggaagggcatgctgggaaggagaagctggagtcaccagaaacccaatgagtgttgatgagccttacta<br>tttgtgtggcgatgggccctactactttctctcaatcctctggccctcttaataaccctcacaaacttcttctctgcaggtca<br>agagaaaggattctga | Human TCR beta constant 1 (TRBC1) NCBI Reference Sequence: NG_001333.2, TRBC1 |

SEQUENCE TABLE-continued

| SEQ ID NO. | SEQUENCE | DESCRIPTION |
|---|---|---|
| 350 | MDSWTFCCVSLCILVAKHTDAGVIQSPRHEVTEMGQEVTLRCKPISGHNSLFWY RQTMRGLELLIYFNNNVPIDDSGMPEDRFSAKMNASFSTLKIQPSEPRDSAVY FCASSLVGRSRTEQYFGPGTRLTVTEDLKNVFPPEVAVFEPSEAEISHTQKATLV CLATGFYPDHVELSWWVNGKEVHSGVCTDPQPLKEQPALNDSRYCLSSRLRVS ATFWQNPRNHFRCQVQFYGLSENDEWTQDRAKPVTQIVSAEAWGRADCGFTSE SYQQGVLSATILYEILLGKATLYAVLVSALVLMAMVKRKDSRGGSGATNFSLLK QAGDVEENPGPMSLSSLLKVTASLWLGPGIAQKITQTQPGMFVQEKEAVTLDC TYDTSDQSYGLFWYKQPSSGEMIFLIYQGSYDEQNATEGRYSLNFQKARKSANL VISASQLGDSAMYFCAMKPGGYNKLIFGAGTRLAVHPYIQNPDPAVYQLRDSKS SDKSVCLFTDFDSQTNVSQSKDSDVYITDKCVLDMRSMDFKSNSAVAWSNKSD FACANAFNNSIIPEDTFFPSPESSCDVKLVEKSFETDTNLNFQNLSVIGFRILLLKV AGFNLLMTLRLWSS | TCR 15 Full sequence Cysteine-modified Homo sapiens (aa) |
| 351 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLIIESASTNQTSM YLCASSLWGRSNQPQHFGDGTRLSILEDLNKVFPPEVAVFEPSEAEISHTQKATL VCLATGFFPDHVELSWWVNGKEVHSGVCTDPQPLKEQPALNDSRYCLSSRLRV SATFWQNPRNHFRCQVQFYGLSENDEWTQDRAKPVTQIVSAEAWGRADCGFTS VSYQQGVLSATILYEILLGKATLYAVLVSALVLMAMVKRKDFGSGATNFSLLKQ AGDVEENPGPMETLLGLLILMLQLQWVSSKQEVTQIPAALSVPEGENLVLNCSF TDSAIYNLQMFRQDPGKGLTSLLLIQSSQREQTSGRLNASLDKSSGRSTLYIAAS QPGDSATYLCAVRPANNNDMRFGAGTRLTVKPNIQNPDPAVYQLRDSKSSDKS VCLFTDFDSQTNVSQSKDSDVYITDKCVLDMRSMDFKSNSAVAWSNKSDFACA NAFNNSIIPEDTFFPSPESSCDVKLVEKSFETDTNLNFQNLSVIGFRILLLKVAGFN LLMTLRLWSS | TCR 16 Full sequence Cysteine-modified Homo sapiens (aa) |
| 352 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLIIESASTNQTSM YLCASSLWGRSNQPQHFGDGTRLSILEDLNKVFPPEVAVFEPSEAEISHTQKATL VCLATGFFPDHVELSWWVNGKEVHSGVCTDPQPLKEQPALNDSRYCLSSRLRV SATFWQNPRNHFRCQVQFYGLSENDEWTQDRAKPVTQIVSAEAWGRADCGFTS VSYQQGVLSATILYEILLGKATLYAVLVSALVLMAMVKRKDFGSGATNFSLLKQ AGDVEENPGPMSLSSLLKVTASLWLGPGIAQKITQTQPGMFVQEKEAVTLDCT YDTSDPSYGLFWYKQPSSGEMIFLIYQGSYDQQNATEGRYSLNFQKARKSANLV ISASQLGDSAMYFCAMREGRGDKIIFGKGTRLHILPNIQNPDPAVYQLRDSKSSD KSVCLFTDFDSQTNVSQSKDSDVYITDKCVLDMRSMDFKSNSAVAWSNKSDFA CANAFNNSIIPEDTFFPSPESSCDVKLVEKSFETDTNLNFQNLSVIGFRILLLKVAG FNLLMTLRLWSS | TCR 17 Full sequence Cysteine-modified Homo sapiens (aa) |
| 353 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLIIESASTNQTSM YLCASSFWGRSNSPLHFGNGTRLTVTEDLNKVFPPEVAVFEPSEAEISHTQKATL VCLATGFFPDHVELSWWVNGKEVHSGVCTDPQPLKEQPALNDSRYCLSSRLRV SATFWQNPRNHFRCQVQFYGLSENDEWTQDRAKPVTQIVSAEAWGRADCGFTS VSYQQGVLSATILYEILLGKATLYAVLVSALVLMAMVKRKDFGSGATNFSLLKQ AGDVEENPGPMETLLGLLILMLQLQWVSSKQEVTQIPAALSVPEGENLVLNCSF TDSAIYNLQMFRQDPGKGLTSLLLIQSSQREQTSGRLNASLDKSSGRSTLYIAAS QPGDSATYLCAEGNAGGTSYGKLTFGQGTILTVHPNIQNPDPAVYQLRDSKSSD | TCR 18 Full sequence Cysteine-modified Homo sapiens (aa) |

SEQUENCE TABLE-continued

| SEQ ID NO. | SEQUENCE | DESCRIPTION |
|---|---|---|
| | KSVCLFTDFDSQTNVSQSKDSDVYITDKCVLDMRSMDFKSNSAVAWSNKSDFA CANAFNNSIIPEDTFFPSPESSCDVKLVEKSFETDTNLNFQNLSVIGFRILLLKVAG FNLLMTLRLWSS | |
| 354 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLIIESASTNQTSM YLCASSWGQSTGEQYFGPGTRLTVTEDLKNVFPPEVAVFEPSEAEISHTQKATL VCLATGFYPDHVELSWWVNGKEVHSGVCTDPQPLKEQPALNDSRYCLSSRLRV SATFWQNPRNHFRCQVQFYGLSENDEWTQDRAKPVTQIVSAEAWGRADCGFTS ESYQQGVLSATILYEILLGKATLYAVLVSALVLMAMVKRKDSRGGSGATNFSLL KQAGDVEENPGPMSLSSLLKVVTASLWLGPGIAQKITQTQPGMFVQEKEAVTLD CTYDTSDQSYGLFWYKQPSSGEMIFLIYQGSYDQNATEGRYSLNFQKARKSAN LVISASQLGDSAMYFCAMRENTGTASKLTFGTGTRLQVTLDIQNPDPAVYQLRD SKSSDKSVCLFTDFDSQTNVSQSKDSDVYITDKCVLDMRSMDFKSNSAVAWSN KSDFACANAFNNSIIPEDTFFPSPESSCDVKLVEKSFETDTNLNFQNLSVIGFRILL LKVAGFNLLMTLRLWSS | TCR 19 Full sequence Cysteine-modified Homo sapiens (aa) |
| 355 | MLLLLLLGPGSGLGAVVSQHPSRVICKSGTSVKIECRSLDFQATTMFWYRQFPK QSLMLATSNEGSKATYEQGVEKDKFLINHASLTLSTLTVTSAHPEDSSFYICSA SSLAARRSYEQYFGPGTRLTVTEDLKNVFPPEVAVFEPSEAEISHTQKATIVCLAT GFYPDHVELSWWVNGKEVHSGVCTDPQPLKEQPALNDSRYCLSSRLRVSATFW QNPRNHFRCQVQFYGLSENDEWTQDRAKPVTQIVSAEAWGRADCGFTSESYQQ GVLSATILYEILLGKATLYAVLVSALVLMAMVKRKDSRGGSGATNFSLLKQAG DVEENPGPMMLTASLLRAVIASICVVSSMAQKVTQAQTEISVVEKEDVTLDCV YETRDTTYYLFWYKQPPSGELVFLIRRNSFDEQNEISGRYSWNFQKSTSSFNFTIT ASQVVDSAVVFCALWTGANNLFFGTGTRLTVIPYIQNPDPAVYQLRDSKSSDKS VCLFTDFDSQTNVSQSKDSDVYITDKCVLDMRSMDFKSNSAVAWSNKSDFACA NAFNNSIIPEDTFFPSPESSCDVKLVEKSFETDTNLNFQNLSVIGFRILLLKVAGFN LLMTLRLWSS | TCR 20 Full sequence Cysteine-modified Homo sapiens (aa) |
| 356 | MHRPRRPLHPVAPAMSIGLLCCVAPSLLWASPVNAGVTQTPKFQVLKTGQSMT LQCAQDMNHNSMYWYRQDPGMGLRLIYYSASEGTTDKGEVPNGYNVSRLNKR EFSLRLESAAPSQTSVYFCASRPWGNQNTEAFFGQGTRLTVEDLNKVFPPEVA VFEPSEAEISHTQKATLVCLATGFFPDHVELSWWVNGKEVHSGVCTDPQPLKEQ PALNDSRYCLSSRLRVSATFWQNPRNHFRCQVQFYGLSENDEWTQDRAKPVTQI VSAEAWGRADCGFTSVSYQQGVLSATILYEILLGKATLYAVLVSALVLMAMVK RKDFGSGATNFSLLKQAGDVEENPGPMSLSSLLKVVTASLWLGPGIAQKITQTQ PGMFVQEKEAVTLDCTYDTSDQSYGLFWYKQPSSGEMIFLIYQGSYDEQNATEG RYSLNFQKARKSANLVISASQLGDSAMYFCAMREGRVTGGGNKLTFGTGTQLK VELNIQNPDPAVYQLRDSKSSDKSVCLFTDFDSQTNVSQSKDSDVYITDKCVLD MRSMDFKSNSAVAWSNKSDFACANAFNNSIIPEDTFFPSPESSCDVKLVEKSFET DTNLNFQNLSVIGFRILLLKVAGFNLLMTLRLWSS | TCR 21 Full sequence Cysteine-modified Homo sapiens (aa) |
| 357 | MGPGLLCWVLLCLLGAGPVDAGVTQSPTHLIKTRGQHVTLRCSPISGHKSVSWY QQVLGQGPQFIFQYYEKEERGRGNFPDRFSARQFPNYSSELNVALLGDSALY LCASSRTENYGYTFGSGTRLTVEDLNKVFPPEVAVFEPSEAEISHTQKATLVCL ATGFFPDHVELSWWVNGKEVHSGVCTDPQPLKEQPALNDSRYCLSSRLRVSATF WQNPRNHFRCQVQFYGLSENDEWTQDRAKPVTQIVSAEAWGRADCGFTSVSY QQGVLSATILYEILLGKATLYAVLVSALVLMAMVKRKDFGSGATNFSLLKQAG | TCR 22 Full sequence Cysteine-modified Homo sapiens (aa) |

SEQUENCE TABLE-continued

| SEQ ID NO. | SEQUENCE | DESCRIPTION |
|---|---|---|
| | DVEENPGPMAQELGMQCQARGILQQMWGVFLLYVSMKMGTTGQNIDQPTE<br>MTATEGAIVQINCTYQTSGFNGLFWYQQHAGEAPTFLSYNVLDGLEEKGRFSSF<br>LSRSKGYSYLLLKELQMKDSASYLCAVRARMDSNYQLIWGAGTKLIIKPDIQNP<br>DPAVYQLRDSKSSDKSVCLFTDFDSQTNVSQSKDSDVYITDKCVLDMRSMDFKS<br>NSAVAWSNKSDFACANAFNNSIIPEDTFFPSPESSCDVKLVEKSFETDTNLNFQN<br>LSVIGFRILLLMTLRLWSS | |
| 358 | MGIRLLCRVAFCFLAVGLVDVKVTQSSRYLVKRTGEKVFLECVQDMDHENMF<br>WYRQDPGLGLRLIYFSYDVKMKEKGDIPEGYSVSREKKERFSLILESASTNQTSM<br>YLCASSPWGQSNQPHFGDGTRLSILEDLNKVFPPEVAVFEPSEAEISHTQKATL<br>VCLATGFFPDHVELSWWVNGKEVHSGVCTDPQPLKEQPALNDSRYCLSSRLRV<br>SATFWQNPRNHFRCQVQFYGLSENDEWTQDRAKPVTQIVSAEAWGRADCGFTS<br>VSYQQGVLSATILYEILLGKATLYAVLVSALVLMAMVKRKDFGSGATNFSLLKQ<br>AGDVEENPGPMSLSSLLKVVTASLWLGPGIAQKITQTQPGMFVQEKEAVTLDCT<br>YDTSDQSYGLFWYKQPSSGEMIFLIYQGSYDEQNATEGRYSLNFQKARKSANLV<br>ISASQLGDSAMYFCAMSPPGGSARQLITFGSGTQLTVLPDIQNPDPAVYQLRDSKS<br>SDKSVCLFTDFDSQTNVSQSKDSDVYITDKCVLDMRSMDFKSNSAVAWSNKSD<br>FACANAFNNSIIPEDTFFPSPESSCDVKLVEKSFETDTNLNFQNLSVIGFRILLLKV<br>AGFNLLMTLRLWSS | TCR 23<br>Full sequence<br>Cysteine-modified<br>Homo sapiens<br>(aa) |
| 359 | MGIRLLCRVAFCFLAVGLVDVKVTQSSRYLVKRTGEKVFLECVQDMDHENMF<br>WYRQDPGLGLRLIYFSYDVKMKEKGDIPEGYSVSREKKERFSLILESASTNQTSM<br>YLCASSPFGRGSYEQYFGPGTRLTVTEDLKNVFPPEVAVFEPSEAEISHTQKATL<br>VCLATGFFPDHVELSWVNGKEVHSGVCTDPQPLKEQPALNDSRYCLSSRLRV<br>SATFWQNPRNHFRCQVQFYGLSENDEWTQDRAKPVTQIVSAEAWGRADCGFTS<br>ESYQQGVLSATILYEILLGKATLYAVLVSALVLMAMVKRKDFSRGGSGATNFSLL<br>KQAGDVEENPGPMSLSSLLKVVTASLWLGPGIAQKITQTQPGMFVQEKERAVTLD<br>CTYDTSDQSYGLFWYKQPSSGEMIFLIYQGSYDEQNATEGRYSLNFQKARKSAN<br>LVISASQLGDSAMYFCAMREGRGDSWGKLQFGAGTQVVVTPDIQNPDPAVYQL<br>RDSKSSDKSVCLFTDFDSQTNVSQSKDSDVYITDKCVLDMRSMDFKSNSAVAW<br>SNKSDFACANAFNNSIIPEDTFFPSPESSCDVKLVEKSFETDTNLNFQNLSVIGFRI<br>LLLKVAGFNLLMTLRLWSS | TCR 24<br>Full sequence<br>Cysteine-modified<br>Homo sapiens<br>(aa) |
| 360 | MGIRLLCRVAFCFLAVGLVDVKVTQSSRYLVKRTGEKVFLECVQDMDHENMF<br>WYRQDPGLGLRLIYFSYDVKMKEKGDIPEGYSVSREKKERFSLILESASTNQTSM<br>YLCASSLWGQSNQPQHFGDGTRLSILEDLNKVFPPEVAVFEPSEAEISHTQKATL<br>VCLATGFFPDHVELSWWVNGKEVHSGVCTDPQPLKEQPALNDSRYCLSSRLRV<br>SATFWQNPRNHFRCQVQFYGLSENDEWTQDRAKPVTQIVSAEAWGRADCGFTS<br>VSYQQGVLSATILYEILLGKATLYAVLVSALVLMAMVKRKDFGSGATNFSLLKQ<br>AGDVEENPGPMSLSSLLKVVTASLWLGPGIAQKITQTQPGMFVQEKEAVTLDCT<br>YDTSDQSYGLFWYKQPSSGEMIFLIYQGSYDEQNATEGRYSLNFQKARKSANLV<br>ISASQLGDSAMYFCAMREGSLTGGNKLTFGTGTQLKVELNIQNPDPAVYQLRD<br>SKSSDKSVCLFTDFDSQTNVSQSKDSDVYITDKCVLDMRSMDFKSNSAVAWSN<br>KSDFACANAFNNSIIPEDTFFPSPESSCDVKLVEKSFETDTNLNFQNLSVIGFRILL<br>LKVAGFNLLMTLRLWSS | TCR 25<br>Full sequence<br>Cysteine-modified<br>Homo sapiens<br>(aa) |
| 361 | MSLGLLCCGAFSLLWAGPVNAGVTQTPKFRVLKTGQSMTLLCAQDMNHEYMY<br>WYRQDPGMGLRLIHYSVGEGTTAKGEVPDGYNVSRLKKQNFLLGLESAAPSQT<br>SVYFCASSYYASGRNYEQYFGPGTRLTVTEDLKNVFPPEVAVFEPSEAEISHTQK | TCR 26<br>Full sequence<br>Cysteine-modified |

| SEQ ID NO. | SEQUENCE | DESCRIPTION |
|---|---|---|
| | ATLVCLATGFYPDHVELSWWVNGKEVHSGVCTDPQPLKEQPALNDSRYCLSSR LRVSATFWQNPRNHFRCQVQFYGLSENDEWTQDRAKPVTQIVSAEAWGRADC GFTSESYQQGVLSATILYEILLGKATLYAVLVSALVLMAMVKRKDSRGGSGATN FSLLKQAGDVEENPGPMSLSSLLKVVTASLWLGPGIAQKITQTQPGMFVQEKEA VTLDCTYDTSDQSYGLFWYKQPSSGEMIFLIYQGSYDEQNATEGRYSLNFQKAR KSANLVISASQLGDSAMYFCAMRDARNNDMRFGAGTRLTVKPNIQNPDPAVYQ LRDSKSSDKSVCLFTDFDSQTNVSQSKDSDVYITDKCVLDMRSMDFKSNSAVA WSNKSDFACANAFNNSIIPEDTFFPSPESSCDVKLVEKSFETDTNLNFQNLSVIGF RILLLKVAGFNLLMTLRLWSS | Homo sapiens (aa) |
| 362 | MHRPRPLHPVAPAMSIGLLCCVAPSLLWASPVNAGVTQTPKFQVLKTGQSMT LQCAQDMNHNSMYWYRQDPGMGLRLIYYSASEGTTDKGEVPNGYNVSRLNKR EFSLRLESAAPSQTSVYFCASSEFGSLNEKLFFGSGTQLSVLEDLNKVFPPEVAVF EPSEAEISHTQKATLVCLATGFFPDHVELSWWVNGKEVHSGVCTDPQPLKEQPA LNDSRYCLSSRLRVSATFWQNPRNHFRCQVQFYGLSENDEWTQDRAKPVTQIVS AEAWGRADCGFTSVSYQQGVLSATILYEILLGKATLYAVLVSALVLMAMVKRK DFGSGATNFSLLKQAGDVEENPGPMKLVTSITVLLSLGIMGDAKTTQPNSMESN EEEPVHLPCNHSTISGTDYIHWYRQLPSQGPEYVIHGLTSNVNNRMASLAIAEDR KSSTLILHRATLRDAAVYYCILRVPPQSGGYQKVTFGTGTKLQVIPNIQNPDPAV YQLRDSKSSDKSVCLFTDFDSQTNVSQSKDSDVYITDKCVLDMRSMDFKSNSAV AWSNKSDFACANAFNNSIIPEDTFFPSPESSCDVKLVEKSFETDTNLNFQNLSVIG FRILLLKVAGFNLLMTLRLWSS | TCR 27 Full sequence Cysteine-modified Homo sapiens (aa) |
| 363 | MGIRLLCRVAFCFLAVGLVDVKVTQSSRYLVKRTGEKVFLECVQDMDHENMF WYRQDPGLGLRLIYFSYDVKMKEKGDIPEGYSVSREKKERFSLILESASTNQTSM YLCASSLWGRSSGNTIYFGEGSWLTVVEDLNKVFPPEVAVFEPSEAEISHTQKAT LVCLATGFFPDHVELSWWVNGKEVHSGVCTDPQPLKEQPALNDSRYCLSSRLR VSATFWQNPRNHFRCQVQFYGLSENDEWTQDRAKPVTQIVSAEAWGRADCGF TSVSYQQGVLSATILYEILLGKATLYAVLVSALVLMAMVKRKDFGSGATNFSLL KQAGDVEENPGPMMISLRVLLVILMLQLSWWSQRKEVEQDPGPFNVPGATV AFNCTYSNSASQSFFWYRQDCRKEPKLLMSVYSSGNEDGRFTAQLNRASQYISL LIRDSKLSDSATYLCVVRGGGTSYGKLTFGQGTILTVHPNIQNPDPAVYQLRDSK SSDKSVCLFTDFDSQTNVSQSKDSDVYITDKCVLDMRSMDFKSNSAVAWSNKS DFACANAFNNSIIPEDTFFPSPESSCDVKLVEKSFETDTNLNFQNLSVIGFRILLLK VAGFNLLMTLRLWSS | TCR 28 Full sequence Cysteine-modified Homo sapiens (aa) |
| 364 | MSNQVLCCVVLCLLGANTVDGGITQSPKYLFRKEGQNVTLSCEQNLNHDAMY WYRQDPGQGLRLIYYSQIVNDFQKGDIARGYSVSREKKESFPLTVTSAQKNPTAF YLCASSPWGRATNEQFFGPCTRLITVLEDLKNVFPPEVAVFEPSEAEISHTQKATL VCLATGFYPDHVELSWWVNGKEVHSGVCTDPQPLKEQPALNDSRYCLSSRLRV SATFWQNPRNHFRCQVQFYGLSENDEWTQDRAKPVTQIVSAEAWGRADCGFTS ESYQQGVLSATILYEILLGKATLYAVLVSALVLMAMVKRKDSRGGSGATNFSLL KQAGDVEENPGPSSLLKVVTASLWLGPGIAQKITQTQPGMFVQEKEAVTLD CTYDTSDQSYGLFWYKQPSSGEMIFLIYQSYDEQNATEGRYSLNFQKARKSAN LVISASQLGDSAMYFCAMRLNTGTASKLTFGTGTRLQVTLDIQNPDPAVYQLRD SKSSDKSVCLFTDFDSQTNVSQSKDSDVYITDKCVLDMRSMDFKSNSAVAWSN KSDFACANAFNNSIIPEDTFFPSPESSCDVKLVEKSFETDTNLNFQNLSVIGFRILL LKVAGFNLLMTLRLWSS | TCR 29 Full sequence Cysteine-modified Homo sapiens (aa) |

SEQUENCE TABLE-continued

| SEQ ID NO. | SEQUENCE | DESCRIPTION |
|---|---|---|
| 365 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CASSRQPSSGNTIYFGEGSWLTVVEDLNKVFPPEVAVFEPSEAEISHTQKATLVC LATGFFPDHVELSWWVNGKEVHSGVCTDPQPLKEQPALNDSRYCLSSRLRVSA TFWQNPRNHFRCQVQFYGLSENDEWTQDRAKPVTQIVSAEAWGRADCGFTSVS YQQGVLSATILYEILLGKATLYAVLVSALVLMAMVKRKDRFGSGATNFSLLKQA GDVEENPGPMRLVARVTVFLTFGTIIDAKTTQPPSMDCAEGRAANLPCNHSTISG NEYVYWYRQIHSQGPQYIIHGLKNNETNEMASLLITEDRKSSTLILPHATLRDTAV YYCIVRGTSVLQGNEKLTFGTGTRLTITIIPNIQNPDPAVYQLRDSKSSDKSVCLFTD FDSQTNVSQSKDSDVYITDKCVLDMRSMDFKSNSAVAWSNKSDFACANAFNNS IIPEDTFFPSPESSCDVKLVEKSFETDTNLNFQNLSVIGPRILLLKVAGFNLLMTLR LWSS | TCR 30 Full sequence Cysteine-modified Homo sapiens (aa) |
| 366 | MGTRLLLFWVAFCLLGADHTGAGVSQSPSNKVTEKGKVLDELRCDPISGHTALYW YRQSLGQGLEFLIYFQGNSAPDKSGLPSDRFSAERTGGSVSTLTIQRTQQEDSAV YLCASSRFLGSTDTQYFGPGTRLTVLEDLKNVFPPEVAVFEPSEAEISHTQKATL VCLATGFYPDHVELSWWNGKEVHSGVCTDPQPLKEQPALNDSRYCLSSRLRV SATFWQNPRNHFRCQVQFYGLSENDEWTQDRAKPVTQIVSAEAWGRADCGFTS ESYQQGVLSATILYEILLGKATLYAVLVSALVLMAMVKRKDSRGGSGATNFSLL KQAGDVEENPGPMAMLLGASVLIIWLQPDWVNSQQKNDDQQVKQNSPLSVQ EGRISILNCDYTNSMFDYPFLWYKKYPAEGPTFLISISSIKDKNEDGRFTVFLNKSA KHLSLHIVPSQPGDSAVYFCAASERGTYKYIFGTGTRLKVLANIQNPDPAVYQLR DSKSSDKSVCLFTDFDSQTNVSQSKDSDVYITDKCVLDMRSMDFKSNSAVAWS NKSDFACANAFNNSIIPEDTFFPSPESSCDVKLVEKSFETDTNLNFQNLSVIGFRIL LLKVAGFNLLMTLRLWSS | TCR 31 Full sequence Cysteine-modified Homo sapiens (aa) |
| 367 | MGFRLLCCVAFCLLGAGPVDSGVTQTPKHLITATGQRVTLRCSPRSGDLSVYWY QQSLDQGLQFLIQYNGEERAKGNILERFSAQQFPDLHSELNLSSLELGDSALYF CASSVGGDHSDEQFFGPGTRLTVLEDLKNVFPPEVAVFEPSEAEISHTQKATLVC LATGFYPDHVELSWWVNGKEVHSGVCTDPQPLKEQPALNDSRYCLSSRLRVSA TFWQNPRNHFRCQVQFYGLSENDEWTQDRAKPVTQIVSAEAWGRADCGFTSES YQQGVLSATILYEILLGKATLYAVLVSALVLMAMVKRKDSRGGSGATNFSLLK QAGDVEENPGPMVLKFSVSILWIQLAWVSTQLLEQSPQFLSIQEGENLTVYCNSS SVFSSLQWYRQEPGEGPVLLVTVVTGGEVKKLKRLTFQFGDARKDSSLHITAAQ PGDTGLYLCAGGSNYKLTFGKGTLLTVNPNIQNPDPAVYQLRDSKSSDKSVCLF TDFDSQTNVSQSKDSDVYITDKCVLDMRSMDFKSNSAVAWSNKSDFACANAFN NSIIPEDTFFPSPESSCDVKLVEKSFETDTNLNFQNLSVIGFRILLLKVAGFNLLMT LRLWSS | TCR 32 Full sequence Cysteine-modified Homo sapiens (aa) |
| 368 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CASTPRDTVEQYFGPGTRLTVTEDLKNVFPPEVAVFEPSEAEISHTQKATLVCLA TGFYPDHVELSWWVNGKEVHSGVCTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVSALVLMAMVKRKDSRGGSGATNFSLLKQ AGDVEENPGPMMKSLRVLVLILWLQLSWWSQQKEVEQNSGPLSVPEGAIASL NCTYSDRGSQSFFWYRQYSGKSPELIMFIYSNGDKEDGRFTAQLNKASQYVSLLI RDSQPSDSATYLCAVNAHTGGFKTIFGAGTRLFVKANIQNPDPAVYQLRDSKS SDKSVCLFTDFDSQTNVSQSKDSDVYITDKCVLDMRSMDFKSNSAVAWSNKSD | TCR 33 Full sequence Cysteine-modified Homo sapiens (aa) |

SEQUENCE TABLE-continued

| SEQ ID NO. | SEQUENCE | DESCRIPTION |
|---|---|---|
|  | FACANAFNNSIIPEDTFFPSPESSCDVKLVEKSFETDTNLNFQNLSVIGFRILLLKV AGFNLLMTLRLWSS |  |
| 369 | MGPGLLCWALLCLLGAGSVETGVTQSPTHLIKTRGQQVTLRCSSQSGHNTVSW YQQALGQGPQFIFQYYREEENGRGNFPPRFSGLQFPNYSSELNVNALELDDSALY LCASSSYAGSYEQYFGPGTRLTVTEDLKNVFPPEVAVFEPSEAEISHTQKATLVC LATGFYPDHVELSWWVNGKEVHSGVCTDPQPLKEQPALNDSRYCLSSRLRVSA TFWQNPRNHFRCQVQFYGLSENDEWTQDRAKPVTQIVSARAWGRADCGFTSES YQQGVLSATILYEILLGKATLYAVLVSALVLMAMVKRKDSRGGSGATNFSLLK QAGDVEENPGPMKKLLAMIWLQLDRLSGELKVEQNPLFLSMQEGKNYTIYCN YSTTSDRLYMYRQDPGKSLSLSLFVLLSNGAVKQEGRLMASLDTKARLSTLHITA AVHDLSATYFCAVSGTYKYIFGTGTRLKVLANIQNPDPAVYQLRDSKSSDKSVC LFTDFDSQTNVSQSKDSDVYITDKCVLDMRSMDFKSNSAVAWSNKSDFACANA FNNSIIPEDTFFPSPESSCDVKLVEKSFETDTNLNFQNLSVIGFRILLLKVAGFNLL MTLRLWSS | TCR 34 Full sequence Cysteine-modified Homo sapiens (aa) |
| 370 | MGFRLLCCVAFCLLGAGPVDSGVTQTPKHLITATGQRVTLRCSPRSGDLSVYWY QQSLDQGLQFLIQYYNGEERAKGNILERFSAQQPPDLHSELNLSSLELGDSALYF CASTTSGDSSYNEQFFGPGTRLTVLEDLKNVFPPEVAVFEPSEAEISHTQKATLVC LATGFYPDHVELSWWVNGKEVHSGVCTDPQPLKEQPALNDSRYCLSSRLRVSA TFWQNPRNHFRCQVQFYGLSENDEWTQDRAKPVTQIVSARAWGRADCGFTSES YQQGVLSATILYEILLGKATLYAVLVSALVLMAMVKRKDSRGGSGATNFSLLK QAGDVEENPGPMALQSTLGAVWLGLLNSLWKVAESKDQVFQPSTVASSEGAV VEIFCNHSVSNAYNFFWYLHFPGCAPRLLVKGSKPSQQGRYNMTYERFSSSLLIL QVREADAAVYCAVAGDYKLSFGAGTTVVRANIQNPDPAVYQLRDSKSSDKS VCLFTDFDSQTNVSQSKDSDVYITDKCVLDMRSMDFKSNSAVAWSNKSDFACA NAFNNSIIPEDTFFPSPESSCDVKLVEKSFETDTNLNFQNLSVIGFRILLLKVAGFN LLMTLRLWSS | TCR 35 Full sequence Cysteine-modified Homo sapiens (aa) |
| 371 | MDTWLVCWAIFSLLKAGLTEPEVTQTPSHQVTQMGQEVILRCVPISNHLYFYWY RQILGQKVEFLVSFYNNEISEKSEIFDDQPSVERPDGSNFTLKIRSTKLEDSAMYF CAMTGRSNYBQYFGPGTRLTVTEDLKNVFPPEVAVFEPSEAEISHTQKATLVCL ATGFYPDHVELSWWVNGKEVHSGVCTDPQPLKEQPALNDSRYCLSSRLRVSAT FWQNPRNHFRCQVQFYGLSENDEWTQDRAKPVTQIVSARAWGRADCGFTSESY QQGVLSATILYEILLGKATLYAVLVSALVLMAMVKRKDSRGGSGATNFSLLKQ AGDVEENPGPMMISLRVLLVILWLQLSWWNSQRKEVEQDPGPFNVPEGATVAF NCTYSNSASQSFFWYRQDCRKEPKLLMSVYSSNEDGRFTAQLNRASQYISLLIR DSKLSDSATYLCVVNRDNYGQNFVFGPGTRLSVLPYIQNPDPAVYQLRDSKSSD KSVCLFTDFDSQTNVSQSKDSDVYITDKCVLDMRSMDFKSNSAVAWSNKSDFA CANAFNNSIIPEDTFFPSPESSCDVKLVEKSFETDTNLNFQNLSVIGFRILLLKVAG FNLLMTLRLWSS | TCR 36 Full sequence Cysteine-modified Homo sapiens (aa) |
| 372 | MGTRLLCWVLGFLGTDHTGAGVSQSPRYKVAKRGQDVALRCDPISGHVSLF WYQQALGQGPEFLTYFQNEAQLDKSGLPSDRFFAERPEGSVSTLKIQRTQQEDS AVYLCASSLLLGAYGYTFGSGTRLTVVEDLNKVFPPEVAVFEPSEAEISHTQKAT LVCLATGFFPDHVELSWWNGKEVHSGVCTDPQPLKEQPALNDSRYCLSSRLR TSVSYQQGVLSATILYEILLGKATLYAVLVSALVLMAMVKRDFGSGATNFSLL TSAITFWQNPRNHFRCQVQFYGLSENDEWTQDRAKPVTQIVSAEAWGRADCGF KQAGDVEENPGPMKKLLAMILWLQLDRLSGELKVEQNPLFLSMQEGKNYTIYC | TCR 37 Full sequence Cysteine-modified Homo sapiens (aa) |

SEQUENCE TABLE-continued

| SEQ ID NO. | SEQUENCE | DESCRIPTION |
|---|---|---|
| | NYSTTSDRLYWYRQDPGKSLESLFVLLSNGAVKQEGRLMASLDTKARLSTLHIT AAVHDLSATYFCAGYSGAGSYQLTFGKGTKLSVIPNIQNPDPAVYQLRDSKSSD KSVCLFTDFDSQTNVSQSKDSDVYITDKCVLDMRSMDFKSNSAVAWSNKSDFA CANAFNNSIIPEDTFFPSPESSCDVKLVEKSFETDTNLNFQNLSVIGFRILLLKVAG FNLLMTLRLWSS | |
| 373 | MGPGLLCWVLLCLLGAGSVETGVTQSPTHLIKTRGQQVTLRCSSQSGHNTVSW YQQALGQGPQFIFQYYREEENGRGNFPPRSGLQFPNYSSELNVNALELDDSALY LCASSLVAGGETQYFGPGTRLLVLEDLKNVFPPEVAVFEPSEAEISHTQKATLVC LATGFYPDHVELSWWVNGKEVHSGVCTDPQPLKEQPALNDSRYCLSSRLRVSA TFWQNPRNHFRCQVQFYGLSENDEWTQDRAKPVTQIVSAEAWGRADCGFTSES YQQGVLSATILYEILLGKATLYAVLVSALVLMAMVKRKDSRGGSGATNFSLLK QAGDVEENPGPMVKMPGARRQSIMKRILGALLGLLSAQVCCVRGIQVEQSPPDL ILQEGANSTLRCNFSDSVNNLQWFHQNPWGQLINLFYIPSGTKQNGRLSATTVA TERYSLLYISSSQTTDSGVYFCAVGFNDMRFGAGTRLTVKPNIQNPDPAVYQLR DSKSSDKSVCLFTDFDSQTNVSQSKDSDVYITDKCVLDMRSMDFKSNSAVAWS NKSDFACANAFNNSIIPEDTFFPSPESSCDVKLVEKSFETDTNLNFQNLSVIGFRIL LLKVAGFNLLMTLRLWSS | TCR 38<br>Full sequence<br>Cysteine-modified<br>Homo sapiens<br>(aa) |
| 374 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CASTPRDRGKEAFFGQGTRLTVEDLNKVFPPEVAVFEPSEAEISHTQKATLVCL ATGFFPDHVELSWWVNGKEVHSGVCTDPQPLKEQPALNDSRYCLSSRLRVSATF WQNPRNHFRCQVQFYGLSENDEWTQDRAKPVTQIVSAEAWGRADCGFTSVSY QQGVLSATILYEILLGKATLYAVLVSALVLMAMVKRKDFPGSGATNFSLLKQAG DVEENPGPMQLTWVSGQQLNQSPQSMFIQEGEDVSMNCTSSSIFNTWLNVYKQE PGEGPVLLIALYKAGELTSNGRLITAQFGITRKDSFLNISASIPSDVGIYFCAGYSSS NDYKLSFGAGTTVTVRANIQNPDPAVYQLRDSKSSDKSVCLFTDFDSQTNVSQS KDSDVYITDKCVLDMRSMDFKSNSAVAWSNKSDFACANAFNNSIIPEDTFFPSPE SSCDVKLVEKSFETDTNLNFQNLSVIGFRILLLKVAGFNLLMTLRLWSS | TCR 39<br>Full sequence<br>Cysteine-modified<br>Homo sapiens<br>(aa) |
| 375 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CAITARSSYEQYFGPGTRLTVEDLKNVFPPEVAVFEPSEAEISHTQKATLVCLAT GFYPDHVELSWWVNGKEVHSGVCTDPQPLKEQPALNDSRYCLSSRLRVSATFW QNPRNHFRCQVQFYGLSENDEWTQDRAKPVTQIVSAEAWGRADCGFTSESYQQ GVLSATILYEILLGKATLYAVLVIWKKLVPGNPFRRSWMKREREMLLITSMLVL DVEENPGPMTSTFQNRPQLFLLIWKKLVPGNPFRRSWMKREREMLLITSMLVL WMQLSQVNGQQVMQIPQYQHVQEGBDFTTYCNSSTTLSNIQWYKQRPGGHPVF LIQLVKSGEVKQKQRLTFQPGEAKNSSLHITATQTTDVGTYFCAGRNMFNKFY FGSGTKLNVKNIQNPDPAVYQLRDSKSSDKSVCLFTDFDSQTNVSQSKDSDVYI TDKCVLDMRSMDFKSNSAVAWSNKSDFACANAFNNSIIPEDTFFPSPESSCDVKL VEKSFETDTNLNFQNLSVIGFRILLLKVAGFNLLMTLRLWSS | TCR 40<br>Full sequence<br>Cysteine-modified<br>Homo sapiens<br>(aa) |
| 376 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CASNPRDRVSYEQYFGPGTRLTVTEDLKNVFPPEVAVFEPSEAEISHTQKATLVC LATGFYPDHVELSWWVNGKEVHSGVCTDPQPLKEQPALNDSRYCLSSRLRVSA TFWQNPRNHFRCQVQFYGLSENDEWTQDRAKPVTQIVSAEAWGRADCGFTSES | TCR 41<br>Full sequence<br>Cysteine-modified<br>Homo sapiens<br>(aa) |

SEQUENCE TABLE-continued

| SEQ ID NO. | SEQUENCE | DESCRIPTION |
|---|---|---|
| | YQQGVLSATILYEILLGKATLYAVLVSALVLMAMVKRDSRGGSGATNFSLLK QAGDVEENPGPMMISLRVLLVILMLQLSWWSQRKEVEQDPGPFNVPEGATVA FNCTYSNSASQSFFWYRQDCRKEPKLLMSVYSSGNEDGRFTAQLNRASQYISLLI RDSKLSDSATYLCVTFALTGGFKTIFGAGTRLFVKANIQNPDPAVYQLRDSKSS DKSVCLFTDFDSQTNVSQSKDSDVYITDKCVLDMRSMDFKSNSAVAWSNKSDF ACANAFNNSIIPEDTFFPSPESSCDVKLVEKSFETDTNLNFQNLSVIGFRILLLKVA GFNLLMTLRLWSS | |
| 377 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CAKTSRSSYBQYFGPGTRLTVTEDDLKNVFPPEVAVFEPSEAEISHTQKATLVCLA TGFYPDHVELSWWVNGKEVHSGVCTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVSALVLMAMVKRKDSRGGSGATNFSLLKQ AGDVEENPGPMHTSTFQNRPQLFLLIWKKLVPGNPFRRSWMKREREMLLITSML VLMWLQSLVNGQQVMQIPQYQHVQEGEDFTTYCNSSTTLSNIQWVKQRPGGH PVFLIQLVKSGEVKKQKRLTFQFGEAKKNSSLHITATQTTDVGTYFCAGPDNFN KFYFGSGTKLNVKPNIQNPDPAVYQLRDSKSSDKSVCLFTDFDSQTNVSQSKDS DVYITDKCVLDMRSMDFKSNSAVAWSNKSDFACANAFNNSIIPEDTFFPSPESSC DVKLVEKSFETDTNLNFQNLSVIGFRILLLKVAGFNLLMTLRLWSS | TCR 42<br>Full sequence<br>Cysteine-modified<br>Homo sapiens<br>(aa) |
| 378 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CASTPRDSYBQYFGPGTRLTVTEDDLKNVFPPEVAVFEPSEAEISHTQKATLVCLA TGFYPDHVELSWWVNGKEVHSGVCTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVSALVLMAMVKRKDSRGGSGATNFSLLKQ AGDVEENPGPMMKSLRVLLVILWLQLSWWNGQQKEVEQNSGPLSVPEGAIASL NCTYSDRGSQSFFWYRQYSGKSPELIMFIYSNGDKEDGRFTAQLNKASQVSLLI RDSQPSDSATYLCAVNVPTSGTYKYIFGTGTRLKVLANIQNPDPAVYQLRDSKSS DKSVCLFTDFDSQTNVSQSKDSDVYITDKCVLDMRSMDFKSNSAVAWSNKSDF ACANAFNNSIIPEDTFFPSPESSCDVKLVEKSFETDTNLNFQNLSVIGFRILLLKVA GFNLLMTLRLWSS | TCR 43<br>Full sequence<br>Cysteine-modified<br>Homo sapiens<br>(aa) |
| 379 | MGFRLLCCVAFCLLGAGPVDSGVTQTPKHLITATGQRVTLRCSPRSGDLSVYWY QQSLDQGLQFLIQYYNGEERAKGNILERFSAQQFPDLHSBLNLSLELGDSALYF CASSGTPDTQYFGPGTRLTVLEDLKNVFPPEVAVFEPSEAEISHTQKATLVCLAT GFYPDHVELSWWVNGKEVHSGVCTDPQPLKEQPALNDSRYCLSSRLRVSATFW QNPRNHFRCQVQFYGLSENDEWTQDRAKPVTQIVSAEAWGRADCGFTSESYQQ GVLSATILYEILLGKATLYAVLVSALVLMAMVKRKDSRGGSGATNFSLLKQAG DVEENPGPMAQELGMQCQARGILQQMMGVFLLYVSMKMGGTTGQNIDQPTE MTATEGAIVQINCTYQTSGFNGLFWYQQHAGEAPTFLSYNVLDGLEEKGRFSSF LSRSKGYSYLLLKELQMKDSASYLCAQYSGGYQKVTFGTGTKLQVIPNIQNPDP AVYQLRDSKSSDKSVCLFTDFDSQTNVSQSKDSDVYITDKCVLDMRSMDFKSNS AVAWSNKSDFACANAFNNSIIPEDTFFPSPESSCDVKLVEKSFETDTNLNFQNLS VIGFRILLLKVAGFNLLMTLRLWSS | TCR 44<br>Full sequence<br>Cysteine-modified<br>Homo sapiens<br>(aa) |
| 380 | MGTRLLFWVAFCLLGAYHTGAGVSQSPSNKVTEKGKDVELRCDPISGHTALYW YRQRLGQGLEFLIYFQGNSAPDKSGLPSDRFSAERTGESVSTLTIQRTQEDSAV | TCR 45<br>Full sequence |

SEQUENCE TABLE-continued

| SEQ ID NO. | SEQUENCE | DESCRIPTION |
|---|---|---|
| | YLCASSLYLGTTGELFFGEGSRLTVLEDLKNVFPPEVAVFEPSEAEISHTQKATLV CLATGFYPDHVELSWWVNGKEVHSGVCTDPQPLKEQPALNDSRYCLSSRLRVS ATFWQNPRNHFRCQVQFYGLSENDEWTQDRAKPVTQIVSAEAWGRADCGFTSE SYQQGVLSATILYEILLGKATLYAVIVSALVLMAMVKRKDSRGGSGATNFSLLK QAGDVEENPGPMHTSTFQNRPQLFLLIWKKLVPGNPFRRSWMKEREMLLITSM LVLMWQLSQVNGQQVMQIPQYQHVQEGEDFTTYCNSSTTLSNIQWYKQRPGG HPVFLIQLVKSGEVKKQKRLITFQFGEAKNSSLHITATQTTDVGTYFCAGSSGA GSYQLTFGKGTKLSVIPNIQNPDPAVYQLRDSKSSDKSVCLFTDFDSQTNVSQSK DSDVYITDKCVLDMRSMDFKSNSAVAWSNKSDFACANAFNNSIIPEDTFFPSPES SCDVKIVEKSFETDTNLNFQNLSVIGFRILLLKVAGFNLLMTLRLWSS | Cysteine-modified Homo sapiens (aa) |
| 381 | MGTRLLCWAALCLLGADHTGAGVSQTPSNKVTEKGKYVELRCDPISGHTALY WYRQSLGQGPEFLIYFQGTGAADDSGLPNDRFFAVRPEGSVSTLKIQRTERGDSA VYLCASSLYLGGSETQYFGPGTRLLVLEDLKNVFPPEVAVFEPSEAEISHTQKAT LVCLATGFYPDHVELSWWVNGKEVHSGVCTDPQPLKEQPALNDSRYCLSSRLR VSATFWQNPRNHFRCQVQFYGLSENDEWTQDRAKPVTQIVSAEAWGRADCGF TSESYQQGVLSATILYEILLGKATLYAVLVSALVLMAMVKRKDSRGGSGATNFS LLKQAGDVEENPGPMLLLLVPAFQVIFTLGGTRAQSVTQLDSQVPVFEEAPVEL RCNYSSSVSVYLFWYVQYPNQGLQLLLKYLSGSTIVKGINGFEAEFNKSQTSFH LRKPSVHISDTAEYFCAVSPSSGTYKYIFGTGTRLKVLANIQNPDPAVYQLRDSK SSDKSVCLFTDFDSQTNVSQSKDSDVYITDKCVLDMRSMDFKSNSAVAWSNKS DFACANAFNNSIIPEDTFFPSPESSCDVKLVEKSFETDTNLNFQNLSVIGFRILLLK VAGFNLLMTLRLWSS | TCR 46 Full sequence Cysteine-modified Homo sapiens (aa) |
| 382 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CAMTGRTTYEQYFGPGTRLTVTEDLKNVFPPEVAVFEPSEAEISHTQKATLVCLA TGFYPDHVELSWWVNGKEVHSGVCTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVIVLWLQLSWWSQQKEVEQNSGPLSVPEGAIASL AGDVEENPGPMMKSLRVLLLVILWLQLSWWSQQKEVEQNSGPLSVPEGAIASL NCTYSDRGSQSPFWYRQYSGKSPELIMFIYSNGDKEDGRFTAQLNKASQYVSLLI RDSQPSDSATYLCAVNLLSGSARQLJTFGSGTQLITVLPDIQNPDPAVYQLRDSKSS DKSVCLFTDFDSQTNVSQSKDSDVYITDKCVLDMRSMDFKSNSAVAWSNKSDF ACANAFNNSIIPEDTFFPSPESSCDVKLVEKSFETDTNLNFQNLSVIGFRILLLKVA GFNLLMTLRLWSS | TCR 47 Full sequence Cysteine-modified Homo sapiens (aa) |
| 383 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CASTGRVSYEQYFGPGTRLTVTEDLKNVFPPEVAVFEPSEAEISHTQKATLVCLA TGFYPDHVELSWWVNGKEVHSGVCTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVIVSALVLMAMVKRKDSRGGSGATNFSLLKQ AGDVEENPGPMMKSLRVLLVILWLQLSWWSQQKEVEQDPGPLSVPEGAIVSL NCTYSNSAFQYFMWYRQYSRKGPELLMYTYSSGNKEDGRFTAQLNPDPAVYQLRDSKSS FIRDSQPSDSATYLCAMRIQGAQKLVFGQGTRLLINPNIQNPDPAVYQLRDSKSS DKSVCLFTDFDSQTNVSQSKDSDVYITDKCVLDMRSMDFKSNSAVAWSNKSDF ACANAFNNSIIPEDTFFPSPESSCDVKLVEKSFETDTNLNFQNLSVIGFRILLLKVA GFNLLMTLRLWSS | TCR 48 Full sequence Cysteine-modified Homo sapiens (aa) |

SEQUENCE TABLE-continued

| SEQ ID NO. | SEQUENCE | DESCRIPTION |
|---|---|---|
| 384 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CASTPRYSVEQYFGPGTRLTVTEDLKNVFPPEVAVFEPSEAEISHTQKATLVCLA TGFYPDHVELSWWVNGKEVHSGVCTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVSALVLMAMVKRKDSRGGSGATNFSLLKQ AGDVEENPGPMMKSLRVLLVILWLQLSWWSQQKEVEQNSGPLSVPEGAIASL NCTYSDRGSQSFFWYRQYSCKSPELIMFIYSNGDKEDGRFTAQLNKASQYVSLLI RDSQPSDSATYLCAVNIGTSGTYKYIFGTGTRLKVLANIQNPDPAVYQLRDSKSS DKSVCLFTDFDSQTNVSQSKDSDVYITDKCVLDMRSMDFKSNSAVAWSNKSDF ACANAFNNSIIPEDTFFPSPESSCDVKLVEKSFETDTNLNFQNLSVIGFRILLLKVA GFNLLMTLRLWSS | TCR 49 Full sequence Cysteine-modified *Homo sapiens* (aa) |
| 385 | MGFRLLCCVAFCLLGAGPVDSGVTQTPKHLITATGQRVTLRCSPRSGDLSVYWY QQSLDQGLQFLIHYNGEERAKGNILERFSAQQFPDLHSELNLSSLELGDSALYF CASSATRDAYGYTFGSGTRLTVVEDLNKVFPPEVAVFEPSEAEISHTQKATLVCL ATGFFPDHVELSWWNGKEVHSGVCTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVSALVLMAMVKRKDFGSGATNFSLLKQAG DVEENPGPMKTFAGFSFLFLWLQLDCMSRGEDVEQSLFLSVREGDSSVINCTYT DSSSTYLYWYKQEPGAGLQLLTYIFSNMDMKQDQRLTVLLNKKDKHLSRLIAD TQTGDSAIYFCAESPPGTYKYIFGTGTRLKVLANIQNPDPAVYQLRDSKSSDKSV CLFTDFDSQTNVSQSKDSDVYITDKCVLDMRSMDFKSNSAVAWSNKSDFACAN AFNNSIIPEDTFFPSPESSCDVKLVEKSFETDTNLNFQNLSVIGFRILLLKVAGFNL LMTLRLWSS | TCR 50 Full sequence Cysteine-modified *Homo sapiens* (aa) |
| 386 | MDTWLVCWAIFSLLKAGLTEPEVTQTPSHQVTQMGQEVILRCVPISNHLYFYWY RQILGQKVEFLVSFYNNEISEKSEIFDDQFSVERPDGSNFTLKIRSTKLEDSAMYF CAIASRVSYEQYFGPGTRLTVTEDLKNVFPPEVAVFEPSEAEISHTQKATLVCLA TGFYPDHVELSWWNGKEVHSGVCTDPQPLKEQPALNDSRYCLSSRLRVSATF WQNPRNHFRCQVQFYGLSENDEWTQDRAKPVTQIVSAEAWGRADCGFTSESY QQGVLSATILYEILLGKATLYAVLVILWLQLSWWSQQKEVEQNSGPLSVPEGAIASL AGDVEENPGPMMKSLRVLLVILWLQLSWWSQQKEVEQNSGPLSVPEGAIASL NCTYSDRGSQSFFWYRQYSGKSPELIMSIYSNGDKEDGRFTAQLNKASQYVSLLI RDSQPSDSATYLCAVNMRGGGSNYKLTFGKGTLLTVNPNIQNPDPAVYQLRDS KSSDKSVCLFTDFDSQTNVSQSKDSDVYITDKCVLDMRSMDFKSNSAVAWSNK SDFACANAFNNSIIPEDTFFPSPESSCDVKLVEKSFETDTNLNFQNLSVIGFRILLL KVAGFNLLMTLRLWSS | TCR 51 Full sequence Cysteine-modified *Homo sapiens* (aa) |
| 387 | MGFRLLCCVAFCLLGAGPVDSGVTQTPKHLITATGQRVTLRCSPRSGDLSVYWY QQSLDQGLQFLIQYNGEERAKGNILERFSAQQFPDLHSELNLSSLELGDSALYF CASSVGDLNNEQFFGPGTRLTVLEDLKNVFPPEVAVFEPSEAEISHTQKATLVCL ATGFYPDHVELSWWNGKEVHSGVCTDPQPLKEQPALNDSRYCLSSRLRVSAT FWQNPRNHFRCQVQFYGLSENDEWTQDRAKPVTQIVSAEAWGRADCGFTSESY QQGVLSATILYEILLGKATLYAVLVSALVLMAMVKRKDSRGGSGATNFSLLKQ AGDVEENPGPMVLKFSVSILMIQLAWVSTQLLEQSPQFLSIQEGENLTVYCNSSS VFSSLQWYRQEPGEGPVLLVTVVTGGEVKKLKRLTFQFGDARKDSSLHITAAQP GDTGLYLCAGARDYKLSFGAGTTVTVRANIQNPDPAVYQLRDSKSSDKSVCLFT | TCR 52 Full sequence Cysteine-modified *Homo sapiens* (aa) |

SEQUENCE TABLE-continued

| SEQ ID NO. | SEQUENCE | DESCRIPTION |
|---|---|---|
| | DFDSQTNVSQSKDSDVYITDKCVLDMRSMDFKSNSAVAWSNKSDFACANAFNN SIIPEDTFFPSPESSCDVKLVEKSFETDTNLNFQNLSVIGFRILLLKVAGFNLLMTL RLWSS | |
| 388 | MGTSLLCWVLGFLGTDHTGAGVSQSPRYKVTKRGQDVALRCDPISGHVSLYW YRQALGQGPEFLTYPNYEAQQDKSGLPNDRFSABRPEGSISTLIQRTEQRDSAM YRCASSGSGTSGYNEQFFGPGTRLTVLEDLKNVFPPEVAVFEPSEAEISHTQKAT LVCLATGFYPDHVELSWWNGKEVHSGVCTDPQPLKEQPALNDSRYCLSSRLR VSAITFWQNPRNHFRCQVQFYGLSENDEWTQDRAKPVTQIVSAEFAWGRADCGF TSESYQQGVLSATILYEILLGKATLYAVLVSALVLMAMVKRKDSRGGSGATNFS LLKQAGDVEENPGPMASAPISMLAMLFTLSGLRAQSVAQPEDQVNVAEGNPLT VKCTYSVSGNPYLFWYVQYPNRGLQFLLKYITGDNLVKGSYGFEAEFNKSQTSF HLKKPSALVSDSALYFCAVRDFGSGTYKYIFGTGTRLKVLANIQNPDPAVYQLR DSKSSDKSVCLFTDFDSQTNVSQSKDSDVYITDKCVLDMRSMDFKSNSAVAWS NKSDFACANAFNNSIIPEDTFFPSPESSCDVKLVEKSFETDTNLNFQNLSVIGFRIL LLKVAGFNLLMTLRLWSS | TCR 53 Full sequence Cysteine-modified Homo sapiens (aa) |
| 389 | TCR 15 - Alpha Native Homo sapiens (nt) | |
| 390 | TCR 15 - Beta Native Homo sapiens (nt) | |
| 391 | TCR 15 Full sequence Native Homo sapiens (aa) | |
| 392 | TCR 16 Full sequence Native Homo sapiens (aa) | |
| 393 | TCR 17 Full sequence Native Homo sapiens (aa) | |
| 394 | TCR 18 Full sequence Native Homo sapiens (aa) | |
| 395 | TCR 19 Full sequence Native Homo sapiens (aa) | |
| 396 | TCR 20 Full sequence Native Homo sapiens (aa) | |
| 397 | TCR 21 Full sequence Native Homo sapiens (aa) | |
| 398 | TCR 22 Full sequence Native Homo sapiens (aa) | |
| 399 | TCR 23 Full sequence Native Homo sapiens (aa) | |
| 400 | TCR 24 Full sequence Native Homo sapiens (aa) | |
| 401 | TCR 25 Full sequence Native Homo sapiens (aa) | |
| 402 | TCR 26 Full sequence Native Homo sapiens (aa) | |
| 403 | TCR 27 Full sequence Native Homo sapiens (aa) | |
| 404 | TCR 28 Full sequence Native Homo sapiens (aa) | |

SEQUENCE TABLE-continued

| SEQ ID NO. | SEQUENCE | DESCRIPTION |
|---|---|---|
| 405 | TCR 29 Full sequence | Native Homo sapiens (aa) |
| 406 | TCR 30 Full sequence | Native Homo sapiens (aa) |
| 407 | TCR 31 Full sequence | Native Homo sapiens (aa) |
| 408 | TCR 32 Full sequence | Native Homo sapiens (aa) |
| 409 | TCR 33 Full sequence | Native Homo sapiens (aa) |
| 410 | TCR 34 Full sequence | Native Homo sapiens (aa) |
| 411 | TCR 35 Full sequence | Native Homo sapiens (aa) |
| 412 | TCR 36 Full sequence | Native Homo sapiens (aa) |
| 413 | TCR 37 Full sequence | Native Homo sapiens (aa) |
| 414 | TCR 38 Full sequence | Native Homo sapiens (aa) |
| 415 | TCR 39 Full sequence | Native Homo sapiens (aa) |
| 416 | TCR 40 Full sequence | Native Homo sapiens (aa) |
| 417 | TCR 41 Full sequence | Native Homo sapiens (aa) |
| 418 | TCR 42 Full sequence | Native Homo sapiens (aa) |
| 419 | TCR 43 Full sequence | Native Homo sapiens (aa) |
| 420 | TCR 44 Full sequence | Native Homo sapiens (aa) |
| 421 | TCR 45 Full sequence | Native Homo sapiens (aa) |
| 422 | TCR 46 Full sequence | Native Homo sapiens (aa) |
| 423 | TCR 47 Full sequence | Native Homo sapiens (aa) |
| 424 | TCR 48 Full sequence | Native Homo sapiens (aa) |
| 425 | TCR 49 Full sequence | Native Homo sapiens (aa) |
| 426 | TCR 50 Full sequence | Native Homo sapiens (aa) |
| 427 | TCR 51 Full sequence | Native Homo sapiens (aa) |
| 428 | TCR 52 Full sequence | Native Homo sapiens (aa) |
| 429 | TCR 53 Full sequence | Native Homo sapiens (aa) |

SEQUENCE TABLE-continued

| SEQ ID NO. | SEQUENCE | DESCRIPTION |
|---|---|---|
| 430 | TCR 16 - Alpha Native Homo sapiens (nt) | |
| 431 | TCR 16 - Beta Native Homo sapiens (nt) | |
| 432 | TCR 15 Codon-optimized/ cysteine-modified full sequence Homo sapiens (nt) | |
| 433 | TCR 16 Codon-optimized/ cysteine-modified full sequence Homo sapiens (nt) | |
| 434 | TCR 17 Codon-optimized/ cysteine-modified full sequence Homo sapiens (nt) | |
| 435 | TCR 18 Codon-optimized/ cysteine-modified full sequence Homo sapiens (nt) | |
| 436 | TCR 19 Codon-optimized/ cysteine-modified full sequence Homo sapiens (nt) | |
| 437 | TCR 20 Codon-optimized/ cysteine-modified full sequence Homo sapiens (nt) | |
| 438 | TCR 21 Codon-optimized/ cysteine-modified full sequence Homo sapiens (nt) | |
| 439 | TCR 22 Codon-optimized/ cysteine-modified full sequence Homo sapiens (nt) | |
| 440 | TCR 23 Codon-optimized/ cysteine-modified full sequence Homo sapiens (nt) | |
| 441 | TCR 24 Codon-optimized/ cysteine-modified full sequence Homo sapiens (nt) | |
| 442 | TCR 25 Codon-optimized/ cysteine-modified full sequence Homo sapiens (nt) | |
| 443 | TCR 26 Codon-optimized/ cysteine-modified full sequence Homo sapiens (nt) | |
| 444 | TCR 27 Codon-optimized/ cysteine-modified full sequence Homo sapiens (nt) | |
| 445 | TCR 28 Codon-optimized/ cysteine-modified full sequence Homo sapiens (nt) | |
| 446 | TCR 29 Codon-optimized/ cysteine-modified full sequence Homo sapiens (nt) | |
| 447 | TCR 30 Codon-optimized/ cysteine-modified full sequence Homo sapiens (nt) | |
| 448 | TCR 31 Codon-optimized/ cysteine-modified full sequence Homo sapiens (nt) | |
| 449 | TCR 32 Codon-optimized/ cysteine-modified full sequence Homo sapiens (nt) | |
| 450 | TCR 33 Codon-optimized/ cysteine-modified full sequence Homo sapiens (nt) | |
| 451 | TCR 34 Codon-optimized/ cysteine-modified full sequence Homo sapiens (nt) | |
| 452 | TCR 35 Codon-optimized/ cysteine-modified full sequence Homo sapiens (nt) | |
| 453 | TCR 36 Codon-optimized/ cysteine-modified full sequence Homo sapiens (nt) | |

SEQUENCE TABLE-continued

| SEQ ID NO. | SEQUENCE | DESCRIPTION |
|---|---|---|
| 454 | TCR 37 | Codon-optimized/cysteine-modified full sequence Homo sapiens (nt) |
| 455 | TCR 38 | Codon-optimized/cysteine-modified full sequence Homo sapiens (nt) |
| 456 | TCR 39 | Codon-optimized/cysteine-modified full sequence Homo sapiens (nt) |
| 457 | TCR 40 | Codon-optimized/cysteine-modified full sequence Homo sapiens (nt) |
| 458 | TCR 41 | Codon-optimized/cysteine-modified full sequence Homo sapiens (nt) |
| 459 | TCR 42 | Codon-optimized/cysteine-modified full sequence Homo sapiens (nt) |
| 460 | TCR 43 | Codon-optimized/cysteine-modified full sequence Homo sapiens (nt) |
| 461 | TCR 44 | Codon-optimized/cysteine-modified full sequence Homo sapiens (nt) |
| 462 | TCR 45 | Codon-optimized/cysteine-modified full sequence Homo sapiens (nt) |
| 463 | TCR 46 | Codon-optimized/cysteine-modified full sequence Homo sapiens (nt) |
| 464 | TCR 47 | Codon-optimized/cysteine-modified full sequence Homo sapiens (nt) |
| 465 | TCR 48 | Codon-optimized/cysteine-modified full sequence Homo sapiens (nt) |
| 466 | TCR 49 | Codon-optimized/cysteine-modified full sequence Homo sapiens (nt) |
| 467 | TCR 50 | Codon-optimized/cysteine-modified full sequence Homo sapiens (nt) |
| 468 | TCR 51 | Codon-optimized/cysteine-modified full sequence Homo sapiens (nt) |
| 469 | TCR 52 | Codon-optimized/cysteine-modified full sequence Homo sapiens (nt) |
| 470 | TCR 53 | Codon-optimized/cysteine-modified full sequence Homo sapiens (nt) |
| 471 | TCR 54 | Codon-optimized/cysteine-modified full sequence Homo sapiens (nt) |
| 472 | TCR 55 | Codon-optimized/cysteine-modified full sequence Homo sapiens (nt) |
| 473 | TCR 15 - Alpha Native Homo sapiens (aa) | |
| 474 | TCR 15 - Alpha Cysteine-modified Homo sapiens (aa) | |
| 475 | TCR 15 - Alpha Native Homo sapiens (aa) | |
| 476 | TCR 15 - Alpha Cysteine-modified Homo sapiens (aa) | |
| 477 | TCR 15 Alpha variable region Homo sapiens (aa) | |
| 478 | TCR 15 alpha CDR3 Homo sapiens (aa) | |

SEQUENCE TABLE-continued

| SEQ ID NO. | SEQUENCE | DESCRIPTION |
|---|---|---|
| 479 | | TCR 15 - Beta Native Homo sapiens (aa) |
| 480 | | TCR 15 - Beta Cysteine-modified Homo sapiens (aa) |
| 481 | | TCR 15 - Beta Native Homo sapiens (aa) |
| 482 | | TCR 15 - Beta Cysteine-modified Homo sapiens (aa) |
| 483 | | TCR 15 beta variable region Homo sapiens (aa) |
| 484 | | TCR 15 Beta CDR1 Homo sapiens (aa) |
| 485 | | TCR 15 Beta CDR2 Homo sapiens (aa) |
| 486 | | TCR 15 Beta CDR3 Homo sapiens (aa) |
| 487 | | TCR 15 - Beta signal peptide Homo sapiens (aa) |
| 488 | | TCR 16 - Alpha Native Homo sapiens (aa) |
| 489 | | TCR 16 - Alpha Cysteine-modified Homo sapiens (aa) |
| 490 | | TCR 16 - Alpha Native Homo sapiens (aa) |
| 491 | | TCR 16 - Alpha Cysteine-modified Homo sapiens (aa) |
| 492 | | TCR 16 Alpha variable region Homo sapiens (aa) |
| 493 | | TCR 16 alpha CDR3 Homo sapiens (aa) |
| 494 | | TCR 16 - Beta Native Homo sapiens (aa) |
| 495 | | TCR 16/ TCR 17 - Beta Cysteine-modified Homo sapiens (aa) |
| 496 | | TCR 16/ TCR 17 - Beta Native Homo sapiens (aa) |
| 497 | | TCR 16/ TCR 17 - Beta Cysteine-modified Homo sapiens (aa) |
| 498 | | TCR 16/ TCR 17 - Beta variable region Homo sapiens (aa) |
| 499 | | TCR 16/ TCR 17 Beta CDR3 Homo sapiens (aa) |
| 500 | | TCR 17 - Alpha Native Homo sapiens (aa) |
| 501 | | TCR 17 - Alpha Cysteine-modified Homo sapiens (aa) |
| 502 | | TCR 17 - Alpha Native Homo sapiens (aa) |

SEQUENCE TABLE-continued

| SEQ ID NO. | SEQUENCE | DESCRIPTION |
|---|---|---|
| 503 | TCR 17 - Alpha Cysteine-modified Homo sapiens (aa) | |
| 504 | TCR 17 Alpha variable region Homo sapiens (aa) | |
| 505 | TCR 17 Alpha CDR3 Homo sapiens (aa) | |
| 506 | TCR 18 - Alpha Native Homo sapiens (aa) | |
| 507 | TCR 18 - Alpha Cysteine-modified Homo sapiens (aa) | |
| 508 | TCR 18 - Alpha Native Homo sapiens (aa) | |
| 509 | TCR 18 - Alpha Cysteine-modified Homo sapiens (aa) | |
| 510 | TCR 18 Alpha variable region Homo sapiens (aa) | |
| 511 | TCR 18 Alpha CDR3 Homo sapiens (aa) | |
| 512 | TCR 18 - Beta Native Homo sapiens (aa) | |
| 513 | TCR 18 - Beta Cysteine-modified Homo sapiens (aa) | |
| 514 | TCR 18 - Beta Native Homo sapiens (aa) | |
| 515 | TCR 18 - Beta Cysteine-modified Homo sapiens (aa) | |
| 516 | TCR 18 Beta variable region Homo sapiens (aa) | |
| 517 | TCR 18 Beta CDR3 Homo sapiens (aa) | |
| 518 | TCR 19 - Alpha Native Homo sapiens (aa) | |
| 519 | TCR 19 - Alpha Cysteine-modified Homo sapiens (aa) | |
| 520 | TCR 19 - Alpha Native Homo sapiens (aa) | |
| 521 | TCR 19 - Alpha Cysteine-modified Homo sapiens (aa) | |
| 522 | TCR 19 Alpha variable region Homo sapiens (aa) | |
| 523 | TCR 19 Alpha CDR3 Homo sapiens (aa) | |
| 524 | TCR 19/ TCR 22/ TCR 23/ TCR 24/ TCR 25/ TCR 47 Native TCR alpha constant region Homo sapiens (aa) | |
| 525 | TCR 19/ TCR 22/ TCR 23/ TCR 24/ TCR 25/ TCR 29/ TCR 47 Alpha constant region Homo sapiens (aa) | |
| 526 | TCR 19 - Beta Native Homo sapiens (aa) | |
| 527 | TCR 19 - Beta Cysteine-modified Homo sapiens (aa) | |

SEQUENCE TABLE-continued

| SEQ ID NO. | SEQUENCE | DESCRIPTION |
|---|---|---|
| 528 | TCR 19 - Beta Native Homo sapiens (aa) | |
| 529 | TCR 19 - Beta Cysteine-modified Homo sapiens (aa) | |
| 530 | TCR 19 Beta variable region Homo sapiens (aa) | |
| 531 | TCR 19 Beta CDR3 Homo sapiens (aa) | |
| 532 | TCR 20 - Alpha Native Homo sapiens (aa) | |
| 533 | TCR 20 - Alpha Cysteine-modified Homo sapiens (aa) | |
| 534 | TCR 20 - Alpha Native Homo sapiens (aa) | |
| 535 | TCR 20 - Alpha Cysteine-modified Homo sapiens (aa) | |
| 536 | TCR 20 Alpha variable region Homo sapiens (aa) | |
| 537 | TCR 20 Alpha CDR1 Homo sapiens (aa) | |
| 538 | TCR 20 Alpha CDR2 Homo sapiens (aa) | |
| 539 | TCR 20 Alpha CDR3 Homo sapiens (aa) | |
| 540 | TCR 20 alpha signal peptide Homo sapiens (aa) | |
| 541 | TCR 20 - Beta Native Homo sapiens (aa) | |
| 542 | TCR 20 - Beta Cysteine-modified Homo sapiens (aa) | |
| 543 | TCR 20 - Beta Native Homo sapiens (aa) | |
| 544 | TCR 20 - Beta Cysteine-modified Homo sapiens (aa) | |
| 545 | TCR 20 Beta variable region Homo sapiens (aa) | |
| 546 | TCR 20 Beta CDR1 Homo sapiens (aa) | |
| 547 | TCR 20 Beta CDR2 Homo sapiens (aa) | |
| 548 | TCR 20 Beta CDR3 Homo sapiens (aa) | |
| 549 | TCR 20 beta signal peptide Homo sapiens (aa) | |
| 550 | TCR 21 - Alpha Native Homo sapiens (aa) | |
| 551 | TCR 21 - Alpha Cysteine-modified Homo sapiens (aa) | |

SEQUENCE TABLE-continued

| SEQ ID NO. | SEQUENCE | DESCRIPTION |
|---|---|---|
| 552 | TCR 21 - Alpha Native Homo sapiens (aa) | |
| 553 | TCR 21 - Alpha Cysteine-modified Homo sapiens (aa) | |
| 554 | TCR 21 Alpha variable region Homo sapiens (aa) | |
| 555 | TCR 21 Alpha CDR3 Homo sapiens (aa) | |
| 556 | TCR 21 - Beta Native Homo sapiens (aa) | |
| 557 | TCR 21 - Beta Cysteine-modified Homo sapiens (aa) | |
| 558 | TCR 21 - Beta Native Homo sapiens (aa) | |
| 559 | TCR 21 - Beta Cysteine-modified Homo sapiens (aa) | |
| 560 | TCR 21 Beta variable region Homo sapiens (aa) | |
| 561 | TCR 21/ TCR 27 Beta CDR1 Homo sapiens (aa) | |
| 562 | TCR 21/ TCR 27 Beta CDR2 Homo sapiens (aa) | |
| 563 | TCR 21 Beta CDR3 Homo sapiens (aa) | |
| 564 | TCR 21/ TCR 27 Beta signal peptide Homo sapiens (aa) | |
| 565 | TCR 22 - Alpha Native Homo sapiens (aa) | |
| 566 | TCR 22 - Alpha Cysteine-modified Homo sapiens (aa) | |
| 567 | TCR 22 - Alpha Native Homo sapiens (aa) | |
| 568 | TCR 22 - Alpha Cysteine-modified Homo sapiens (aa) | |
| 569 | TCR 22 Alpha variable region Homo sapiens (aa) | |
| 570 | TCR 22/ TCR 44 Alpha CDR1 Homo sapiens (aa) | |
| 571 | TCR 22/ TCR 44 Alpha CDR2 Homo sapiens (aa) | |
| 572 | TCR 22 Alpha CDR3 Homo sapiens (aa) | |
| 573 | TCR 22/ TCR 44Alpha signal peptide Homo sapiens (aa) | |
| 574 | TCR 22 - Beta Native Homo sapiens (aa) | |
| 575 | TCR 22 - Beta Cysteine-modified Homo sapiens (aa) | |
| 576 | TCR 22 - Beta Native Homo sapiens (aa) | |

SEQUENCE TABLE-continued

| SEQ ID NO. | SEQUENCE | DESCRIPTION |
|---|---|---|
| 577 | TCR 22 - Beta Cysteine-modified Homo sapiens (aa) | |
| 578 | TCR 22 Beta variable region Homo sapiens (aa) | |
| 579 | TCR 22 Beta CDR1 Homo sapiens (aa) | |
| 580 | TCR 22 Beta CDR2 Homo sapiens (aa) | |
| 581 | TCR 22 Beta CDR3 Homo sapiens (aa) | |
| 582 | TCR 22 Beta signal peptide Homo sapiens (aa) | |
| 583 | TCR 23 - Alpha Native Homo sapiens (aa) | |
| 584 | TCR 23 - Alpha Cysteine-modified Homo sapiens (aa) | |
| 585 | TCR 23 - Alpha Native Homo sapiens (aa) | |
| 586 | TCR 23 - Alpha Cysteine-modified Homo sapiens (aa) | |
| 587 | TCR 23 Alpha variable region Homo sapiens (aa) | |
| 588 | TCR 23 Alpha CDR3 Homo sapiens (aa) | |
| 589 | TCR 23 - Beta Native Homo sapiens (aa) | |
| 590 | TCR 23 - Beta Cysteine-modified Homo sapiens (aa) | |
| 591 | TCR 23 - Beta Native Homo sapiens (aa) | |
| 592 | TCR 23 - Beta Cysteine-modified Homo sapiens (aa) | |
| 593 | TCR 23 Beta variable region Homo sapiens (aa) | |
| 594 | TCR 23 Beta CDR3 Homo sapiens (aa) | |
| 595 | TCR 24 - Alpha Native Homo sapiens (aa) | |
| 596 | TCR 24 - Alpha Cysteine-modified Homo sapiens (aa) | |
| 597 | TCR 24 - Alpha Native Homo sapiens (aa) | |
| 598 | TCR 24 - Alpha Cysteine-modified Homo sapiens (aa) | |
| 599 | TCR 24 Alpha variable region Homo sapiens (aa) | |
| 600 | TCR 24 Alpha CDR3 Homo sapiens (aa) | |

SEQUENCE TABLE-continued

| SEQ ID NO. | SEQUENCE | DESCRIPTION |
|---|---|---|
| 601 | TCR 24 - Beta Native Homo sapiens (aa) | |
| 602 | TCR 24 - Beta Cysteine-modified Homo sapiens (aa) | |
| 603 | TCR 24 - Beta Native Homo sapiens (aa) | |
| 604 | TCR 24 - Beta Cysteine-modified Homo sapiens (aa) | |
| 605 | TCR 24 Beta variable region Homo sapiens (aa) | |
| 606 | TCR 24 Beta CDR3 Homo sapiens (aa) | |
| 607 | TCR 25 - Alpha Native Homo sapiens (aa) | |
| 608 | TCR 25 - Alpha Cysteine-modified Homo sapiens (aa) | |
| 609 | TCR 25 - Alpha Native Homo sapiens (aa) | |
| 610 | TCR 25 - Alpha Cysteine-modified Homo sapiens (aa) | |
| 611 | TCR 25 Alpha variable region Homo sapiens (aa) | |
| 612 | TCR 25 Alpha CDR3 Homo sapiens (aa) | |
| 613 | TCR 25 - Beta Native Homo sapiens (aa) | |
| 614 | TCR 25 - Beta Cysteine-modified Homo sapiens (aa) | |
| 615 | TCR 25 - Beta Native Homo sapiens (aa) | |
| 616 | TCR 25 - Beta Cysteine-modified Homo sapiens (aa) | |
| 617 | TCR 25 Beta variable region Homo sapiens (aa) | |
| 618 | TCR 25 Beta CDR3 Homo sapiens (aa) | |
| 619 | TCR 26 - Alpha Native Homo sapiens (aa) | |
| 620 | TCR 26 - Alpha Cysteine-modified Homo sapiens (aa) | |
| 621 | TCR 26 - Alpha Native Homo sapiens (aa) | |
| 622 | TCR 26 - Alpha Cysteine-modified Homo sapiens (aa) | |
| 623 | TCR 26 Alpha variable region Homo sapiens (aa) | |
| 624 | TCR 26 Alpha CDR3 Homo sapiens (aa) | |
| 625 | TCR 26 - Beta Native Homo sapiens (aa) | |

SEQUENCE TABLE-continued

| SEQ ID NO. | SEQUENCE | DESCRIPTION |
|---|---|---|
| 626 | | TCR 26 - Beta Cysteine-modified Homo sapiens (aa) |
| 627 | | TCR 26 - Beta Native Homo sapiens (aa) |
| 628 | | TCR 26 - Beta Cysteine-modified Homo sapiens (aa) |
| 629 | | TCR 26 Beta variable region Homo sapiens (aa) |
| 630 | | TCR 26 Beta CDR3 Homo sapiens (aa) |
| 631 | | TCR 26 - Native TCR beta constant region Homo sapiens (aa) |
| 632 | | TCR 26 - TCR beta constant region Homo sapiens (aa) |
| 633 | | TCR 27 - Alpha Native Homo sapiens (aa) |
| 634 | | TCR 27 - Alpha Cysteine-modified Homo sapiens (aa) |
| 635 | | TCR 27 - Alpha Native Homo sapiens (aa) |
| 636 | | TCR 27 - Alpha Cysteine-modified Homo sapiens (aa) |
| 637 | | TCR 27 Alpha variable region Homo sapiens (aa) |
| 638 | | TCR 27 Alpha CDR3 Homo sapiens (aa) |
| 639 | | TCR 27 - Beta Native Homo sapiens (aa) |
| 640 | | TCR 27 - Beta Cysteine-modified Homo sapiens (aa) |
| 641 | | TCR 27 - Beta Native Homo sapiens (aa) |
| 642 | | TCR 27 - Beta Cysteine-modified Homo sapiens (aa) |
| 643 | | TCR 27 Beta variable region Homo sapiens (aa) |
| 644 | | TCR 27 Beta CDR3 Homo sapiens (aa) |
| 645 | | TCR 28 - Alpha Native Homo sapiens (aa) |
| 646 | | TCR 28 - Alpha Cysteine-modified Homo sapiens (aa) |
| 647 | | TCR 28 - Alpha Native Homo sapiens (aa) |
| 648 | | TCR 28 - Alpha Cysteine-modified Homo sapiens (aa) |
| 649 | | TCR 28 Alpha variable region Homo sapiens (aa) |

SEQUENCE TABLE-continued

| SEQ ID NO. | SEQUENCE | DESCRIPTION |
|---|---|---|
| 650 | TCR 28 Alpha CDR3 Homo sapiens (aa) | |
| 651 | TCR 28 - Beta Native Homo sapiens (aa) | |
| 652 | TCR 28 - Beta Cysteine-modified Homo sapiens (aa) | |
| 653 | TCR 28 - Beta Native Homo sapiens (aa) | |
| 654 | TCR 28 - Beta Cysteine-modified Homo sapiens (aa) | |
| 655 | TCR 28 Beta variable region Homo sapiens (aa) | |
| 656 | TCR 28 Beta CDR3 Homo sapiens (aa) | |
| 657 | TCR 29 - Alpha Native Homo sapiens (aa) | |
| 658 | TCR 29 - Alpha Cysteine-modified Homo sapiens (aa) | |
| 659 | TCR 29 - Alpha Native Homo sapiens (aa) | |
| 660 | TCR 29 - Alpha Cysteine-modified Homo sapiens (aa) | |
| 661 | TCR 29 Alpha variable region Homo sapiens (aa) | |
| 662 | TCR 29 Alpha CDR3 Homo sapiens (aa) | |
| 663 | TCR 29 - Beta Native Homo sapiens (aa) | |
| 664 | TCR 29 - Beta Cysteine-modified Homo sapiens (aa) | |
| 665 | TCR 29 - Beta Native Homo sapiens (aa) | |
| 666 | TCR 29 - Beta Cysteine-modified Homo sapiens (aa) | |
| 667 | TCR 29 Beta variable region Homo sapiens (aa) | |
| 668 | TCR 29 Beta CDR1 Homo sapiens (aa) | |
| 669 | TCR 29 Beta CDR2 Homo sapiens (aa) | |
| 670 | TCR 29 Beta CDR3 Homo sapiens (aa) | |
| 671 | TCR 29 Beta signal peptide Homo sapiens (aa) | |
| 672 | TCR 30 - Alpha Native Homo sapiens (aa) | |
| 673 | TCR 30 - Alpha Cysteine-modified Homo sapiens (aa) | |
| 674 | TCR 30 - Alpha Native Homo sapiens (aa) | |

SEQUENCE TABLE-continued

| SEQ ID NO. | SEQUENCE | DESCRIPTION |
|---|---|---|
| 675 | | TCR 30 - Alpha Cysteine-modified Homo sapiens (aa) |
| 676 | | TCR 30 Alpha variable region Homo sapiens (aa) |
| 677 | | TCR 30 Alpha CDR1 Homo sapiens (aa) |
| 678 | | TCR 30 Alpha CDR2 Homo sapiens (aa) |
| 679 | | TCR 30 Alpha CDR3 Homo sapiens (aa) |
| 680 | | TCR 30 Alpha signal peptide Homo sapiens (aa) |
| 681 | | TCR 30 - Beta Native Homo sapiens (aa) |
| 682 | | TCR 30 - Beta Cysteine-modified Homo sapiens (aa) |
| 683 | | TCR 30 - Beta Native Homo sapiens (aa) |
| 684 | | TCR 30 - Beta Cysteine-modified Homo sapiens (aa) |
| 685 | | TCR 30 Beta variable region Homo sapiens (aa) |
| 686 | | TCR 30 Beta CDR3 Homo sapiens (aa) |
| 687 | | TCR 31 - Alpha Native Homo sapiens (aa) |
| 688 | | TCR 31 - Alpha Cysteine-modified Homo sapiens (aa) |
| 689 | | TCR 31 - Alpha Native Homo sapiens (aa) |
| 690 | | TCR 31 - Alpha Cysteine-modified Homo sapiens (aa) |
| 691 | | TCR 31 Alpha variable region Homo sapiens (aa) |
| 692 | | TCR 31 Alpha CDR1 Homo sapiens (aa) |
| 693 | | TCR 31 Alpha CDR2 Homo sapiens (aa) |
| 694 | | TCR 31 Alpha CDR3 Homo sapiens (aa) |
| 695 | | TCR 31 Alpha signal peptide Homo sapiens (aa) |
| 696 | | TCR 31 - Beta Native Homo sapiens (aa) |
| 697 | | TCR 31 - Beta Cysteine-modified Homo sapiens (aa) |
| 698 | | TCR 31 - Beta Native Homo sapiens (aa) |

| SEQ ID NO. | SEQUENCE DESCRIPTION |
|---|---|
| 699 | TCR 31 - Beta Cysteine-modified Homo sapiens (aa) |
| 700 | TCR 31 Beta variable region Homo sapiens (aa) |
| 701 | TCR 31/ TCR 45/ TCR 46 Beta CDR1 Homo sapiens (aa) |
| 702 | TCR 31/ TCR 45 Beta CDR2 Homo sapiens (aa) |
| 703 | TCR 31 Beta CDR3 Homo sapiens (aa) |
| 704 | TCR 31/ TCR 32 Beta signal peptide Homo sapiens (aa) |
| 705 | TCR 32 - Alpha Native Homo sapiens (aa) |
| 706 | TCR 32 - Alpha Cysteine-modified Homo sapiens (aa) |
| 707 | TCR 32 - Alpha Native Homo sapiens (aa) |
| 708 | TCR 32 - Alpha Cysteine-modified Homo sapiens (aa) |
| 709 | TCR 32 Alpha variable region Homo sapiens (aa) |
| 710 | TCR 32/ TCR 52 Alpha CDR1 Homo sapiens (aa) |
| 711 | TCR 32/ TCR 52 Alpha CDR2 Homo sapiens (aa) |
| 712 | TCR 32 Alpha CDR3 Homo sapiens (aa) |
| 713 | TCR 32/ TCR 52 Alpha signal peptide Homo sapiens (aa) |
| 714 | TCR 32 - Beta Native Homo sapiens (aa) |
| 715 | TCR 32 - Beta Cysteine-modified Homo sapiens (aa) |
| 716 | TCR 32 - Beta Native Homo sapiens (aa) |
| 717 | TCR 32 - Beta Cysteine-modified Homo sapiens (aa) |
| 718 | TCR 32 Beta variable region Homo sapiens (aa) |
| 719 | TCR 32/ TCR 35/ TCR 44/ TCR 50/ TCR 52 Beta CDR1 Homo sapiens (aa) |
| 720 | TCR 32/ TCR 35/ TCR 44/ TCR 50/ TCR 52 Beta CDR2 Homo sapiens (aa) |
| 721 | TCR 32 Beta CDR3 Homo sapiens (aa) |
| 722 | TCR 33 - Alpha Native Homo sapiens (aa) |
| 723 | TCR 33 - Alpha Cysteine-modified Homo sapiens (aa) |

SEQUENCE TABLE-continued

| SEQ ID NO. | SEQUENCE | DESCRIPTION |
|---|---|---|
| 724 | | TCR 33 - Alpha Native Homo sapiens (aa) |
| 725 | | TCR 33 - Alpha Cysteine-modified Homo sapiens (aa) |
| 726 | | TCR 33 Alpha variable region Homo sapiens (aa) |
| 727 | | TCR 33/ TCR 43/ TCR 47/ TCR 49/ TCR 51 Alpha CDR1 Homo sapiens (aa) |
| 728 | | TCR 33/ TCR 43/ TCR 47/ TCR 49/ TCR 51 Alpha CDR2 Homo sapiens (aa) |
| 729 | | TCR 33 Alpha CDR3 Homo sapiens (aa) |
| 730 | | TCR 33/ TCR 43/ TCR 47/ TCR 48/ TCR 49/ TCR 51 Alpha signal peptide Homo sapiens (aa) |
| 731 | | TCR 33 - Beta Native Homo sapiens (aa) |
| 732 | | TCR 33 - Beta Cysteine-modified Homo sapiens (aa) |
| 733 | | TCR 33 - Beta Native Homo sapiens (aa) |
| 734 | | TCR 33 - Beta Cysteine-modified Homo sapiens (aa) |
| 735 | | TCR 33 Beta variable region Homo sapiens (aa) |
| 736 | | TCR 33 Beta CDR3 Homo sapiens (aa) |
| 737 | | TCR 34 - Alpha Native Homo sapiens (aa) |
| 738 | | TCR 34 - Alpha Cysteine-modified Homo sapiens (aa) |
| 739 | | TCR 34 - Alpha Native Homo sapiens (aa) |
| 740 | | TCR 34 - Alpha Cysteine-modified Homo sapiens (aa) |
| 741 | | TCR 34 Alpha variable region Homo sapiens (aa) |
| 742 | | TCR 34/ TCR 37 Alpha CDR1 Homo sapiens (aa) |
| 743 | | TCR 34/ TCR 37 Alpha CDR2 Homo sapiens (aa) |
| 744 | | TCR 34 Alpha CDR3 Homo sapiens (aa) |
| 745 | | TCR 34/ TCR 37 Alpha signal peptide Homo sapiens (aa) |
| 746 | | TCR 34 - Beta Native Homo sapiens (aa) |
| 747 | | TCR 34 - Beta Cysteine-modified Homo sapiens (aa) |

SEQUENCE TABLE-continued

| SEQ ID NO. | SEQUENCE | DESCRIPTION |
|---|---|---|
| 748 | TCR 34 - Beta Native Homo sapiens (aa) | |
| 749 | TCR 34 - Beta Cysteine-modified Homo sapiens (aa) | |
| 750 | TCR 34 Beta variable region Homo sapiens (aa) | |
| 751 | TCR 34/ TCR 38 Beta CDR1 Homo sapiens (aa) | |
| 752 | TCR 34/ TCR 38 Beta CDR2 Homo sapiens (aa) | |
| 753 | TCR 34 Beta CDR3 Homo sapiens (aa) | |
| 754 | TCR 34 Beta signal peptide Homo sapiens (aa) | |
| 755 | TCR 35 - Alpha Native Homo sapiens (aa) | |
| 756 | TCR 35 - Alpha Cysteine-modified Homo sapiens (aa) | |
| 757 | TCR 35 - Alpha Native Homo sapiens (aa) | |
| 758 | TCR 35 - Alpha Cysteine-modified Homo sapiens (aa) | |
| 759 | TCR 35 Alpha variable region Homo sapiens (aa) | |
| 760 | TCR 35 Alpha CDR1 Homo sapiens (aa) | |
| 761 | TCR 35 Alpha CDR2 Homo sapiens (aa) | |
| 762 | TCR 35 Alpha CDR3 Homo sapiens (aa) | |
| 763 | TCR 35 Alpha signal peptide Homo sapiens (aa) | |
| 764 | TCR 35 - Beta Native Homo sapiens (aa) | |
| 765 | TCR 35 - Beta Cysteine-modified Homo sapiens (aa) | |
| 766 | TCR 35 - Beta Native Homo sapiens (aa) | |
| 767 | TCR 35 - Beta Cysteine-modified Homo sapiens (aa) | |
| 768 | TCR 35 Beta variable region Homo sapiens (aa) | |
| 769 | TCR 35 Beta CDR3 Homo sapiens (aa) | |
| 770 | TCR 35/ TCR 44/ TCR 50/ TCR 52Beta signal peptide Homo sapiens (aa) | |
| 771 | TCR 36 - Alpha Native Homo sapiens (aa) | |
| 772 | TCR 36 - Alpha Cysteine-modified Homo sapiens (aa) | |

| SEQ ID NO. | SEQUENCE | DESCRIPTION |
|---|---|---|
| 773 | | TCR 36 - Alpha Native Homo sapiens (aa) |
| 774 | | TCR 36 - Alpha Cysteine-modified Homo sapiens (aa) |
| 775 | | TCR 36 Alpha variable region Homo sapiens (aa) |
| 776 | | TCR 36 Alpha CDR3 Homo sapiens (aa) |
| 777 | | TCR 36 - Beta Native Homo sapiens (aa) |
| 778 | | TCR 36 - Beta Cysteine-modified Homo sapiens (aa) |
| 779 | | TCR 36 - Beta Native Homo sapiens (aa) |
| 780 | | TCR 36 - Beta Cysteine-modified Homo sapiens (aa) |
| 781 | | TCR 36 Beta variable region Homo sapiens (aa) |
| 782 | | TCR 36 Beta CDR3 Homo sapiens (aa) |
| 783 | | TCR 37 - Alpha Native Homo sapiens (aa) |
| 784 | | TCR 37 - Alpha Cysteine-modified Homo sapiens (aa) |
| 785 | | TCR 37 - Alpha Native Homo sapiens (aa) |
| 786 | | TCR 37 - Alpha Cysteine-modified Homo sapiens (aa) |
| 787 | | TCR 37 Alpha variable region Homo sapiens (aa) |
| 788 | | TCR 37 Alpha CDR3 Homo sapiens (aa) |
| 789 | | TCR 37 - Beta Native Homo sapiens (aa) |
| 790 | | TCR 37 - Beta Cysteine-modified Homo sapiens (aa) |
| 791 | | TCR 37 - Beta Native Homo sapiens (aa) |
| 792 | | TCR 37 - Beta Cysteine-modified Homo sapiens (aa) |
| 793 | | TCR 37 Beta variable region Homo sapiens (aa) |
| 794 | | TCR 37 Beta CDR3 Homo sapiens (aa) |
| 795 | | TCR 38 - Alpha Native Homo sapiens (aa) |
| 796 | | TCR 38 - Alpha Cysteine-modified Homo sapiens (aa) |

SEQUENCE TABLE-continued

| SEQ ID NO. | SEQUENCE | DESCRIPTION |
|---|---|---|
| 797 | TCR 38 - Alpha Native Homo sapiens (aa) | |
| 798 | TCR 38 - Alpha Cysteine-modified Homo sapiens (aa) | |
| 799 | TCR 38 Alpha variable region Homo sapiens (aa) | |
| 800 | TCR 38 Alpha CDR1 Homo sapiens (aa) | |
| 801 | TCR 38 Alpha CDR2 Homo sapiens (aa) | |
| 802 | TCR 38 Alpha CDR3 Homo sapiens (aa) | |
| 803 | TCR 38 Alpha signal peptide Homo sapiens (aa) | |
| 804 | TCR 38 - Beta Native Homo sapiens (aa) | |
| 805 | TCR 38 - Beta Cysteine-modified Homo sapiens (aa) | |
| 806 | TCR 38 - Beta Native Homo sapiens (aa) | |
| 807 | TCR 38 - Beta Cysteine-modified Homo sapiens (aa) | |
| 808 | TCR 38 Beta variable region Homo sapiens (aa) | |
| 809 | TCR 38 Beta CDR3 Homo sapiens (aa) | |
| 810 | TCR 38 Beta signal peptide Homo sapiens (aa) | |
| 811 | TCR 39 - Alpha Native Homo sapiens (aa) | |
| 812 | TCR 39 - Alpha Cysteine-modified Homo sapiens (aa) | |
| 813 | TCR 39 - Alpha Native Homo sapiens (aa) | |
| 814 | TCR 39 - Alpha Cysteine-modified Homo sapiens (aa) | |
| 815 | TCR 39 Alpha variable region Homo sapiens (aa) | |
| 816 | TCR 39/ TCR 40/ TCR 42/ TCR 45 Alpha CDR1 Homo sapiens (aa) | |
| 817 | TCR 39 Alpha CDR2 Homo sapiens (aa) | |
| 818 | TCR 39 Alpha CDR3 Homo sapiens (aa) | |
| 819 | TCR 39 Alpha signal peptide Homo sapiens (aa) | |
| 820 | TCR 39 - Beta Native Homo sapiens (aa) | |
| 821 | TCR 39 - Beta Cysteine-modified Homo sapiens (aa) | |

| SEQ ID NO. | SEQUENCE | DESCRIPTION |
|---|---|---|
| 822 | | TCR 39 - Beta Native Homo sapiens (aa) |
| 823 | | TCR 39 - Beta Cysteine-modified Homo sapiens (aa) |
| 824 | | TCR 39 Beta variable region Homo sapiens (aa) |
| 825 | | TCR 39 Beta CDR3 Homo sapiens (aa) |
| 826 | | TCR 40 - Alpha Native Homo sapiens (aa) |
| 827 | | TCR 40 - Alpha Cysteine-modified Homo sapiens (aa) |
| 828 | | TCR 40 - Alpha Native Homo sapiens (aa) |
| 829 | | TCR 40 - Alpha Cysteine-modified Homo sapiens (aa) |
| 830 | | TCR 40 Alpha variable region Homo sapiens (aa) |
| 831 | | TCR 40 Alpha CDR2 Homo sapiens (aa) |
| 832 | | TCR 40/ TCR 42 Alpha CDR3 Homo sapiens (aa) |
| 833 | | Transmembrane-modified/cysteine modified mouse constant alpha Mus musculus (aa) |
| 834 | | TCR 40/ TCR 42/ TCR 45 Alpha signal peptide Homo sapiens (aa) |
| 835 | | TCR 40 - Beta Native Homo sapiens (aa) |
| 836 | | TCR 40 - Beta Cysteine-modified Homo sapiens (aa) |
| 837 | | TCR 40 - Beta Native Homo sapiens (aa) |
| 838 | | TCR 40 - Beta Cysteine-modified Homo sapiens (aa) |
| 839 | | TCR 40 Beta variable region Homo sapiens (aa) |
| 840 | | TCR 40 Beta CDR3 Homo sapiens (aa) |
| 841 | | TCR 41 - Alpha Native Homo sapiens (aa) |
| 842 | | TCR 41 - Alpha Cysteine-modified Homo sapiens (aa) |
| 843 | | TCR 41 - Alpha Native Homo sapiens (aa) |
| 844 | | TCR 41 - Alpha Cysteine-modified Homo sapiens (aa) |
| 845 | | TCR 41 Alpha variable region Homo sapiens (aa) |

SEQUENCE TABLE-continued

| SEQ ID NO. | SEQUENCE | DESCRIPTION |
|---|---|---|
| 846 | TCR 41 Alpha CDR3 Homo sapiens (aa) | |
| 847 | TCR 41 - Beta Native Homo sapiens (aa) | |
| 848 | TCR 41 - Beta Cysteine-modified Homo sapiens (aa) | |
| 849 | TCR 41 - Beta Native Homo sapiens (aa) | |
| 850 | TCR 41 - Beta Cysteine-modified Homo sapiens (aa) | |
| 851 | TCR 41 Beta variable region Homo sapiens (aa) | |
| 852 | TCR 41 Beta CDR3 Homo sapiens (aa) | |
| 853 | TCR 42 - Alpha Native Homo sapiens (aa) | |
| 854 | TCR 42 - Alpha Cysteine-modified Homo sapiens (aa) | |
| 855 | TCR 42 - Alpha Native Homo sapiens (aa) | |
| 856 | TCR 42 - Alpha Cysteine-modified Homo sapiens (aa) | |
| 857 | TCR 42 Alpha variable region Homo sapiens (aa) | |
| 858 | TCR 42 Alpha CDR3 Homo sapiens (aa) | |
| 859 | TCR 42 - Beta Native Homo sapiens (aa) | |
| 860 | TCR 42 - Beta Cysteine-modified Homo sapiens (aa) | |
| 861 | TCR 42 - Beta Native Homo sapiens (aa) | |
| 862 | TCR 42 - Beta Cysteine-modified Homo sapiens (aa) | |
| 863 | TCR 42 Beta variable region Homo sapiens (aa) | |
| 864 | TCR 42 Beta CDR3 Homo sapiens (aa) | |
| 865 | TCR 43 - Alpha Native Homo sapiens (aa) | |
| 866 | TCR 43 - Alpha Cysteine-modified Homo sapiens (aa) | |
| 867 | TCR 43 - Alpha Native Homo sapiens (aa) | |
| 868 | TCR 43 - Alpha Cysteine-modified Homo sapiens (aa) | |
| 869 | TCR 43 Alpha variable region Homo sapiens (aa) | |
| 870 | TCR 43 Alpha CDR3 Homo sapiens (aa) | |

SEQUENCE TABLE-continued

| SEQ ID NO. | SEQUENCE | DESCRIPTION |
|---|---|---|
| 871 | | TCR 43 - Beta Native Homo sapiens (aa) |
| 872 | | TCR 43 - Beta Cysteine-modified Homo sapiens (aa) |
| 873 | | TCR 43 - Beta Native Homo sapiens (aa) |
| 874 | | TCR 43 - Beta Cysteine-modified Homo sapiens (aa) |
| 875 | | TCR 43 Beta variable region Homo sapiens (aa) |
| 876 | | TCR 43 Beta CDR3 Homo sapiens (aa) |
| 877 | | TCR 44 - Alpha Native Homo sapiens (aa) |
| 878 | | TCR 44 - Alpha Cysteine-modified Homo sapiens (aa) |
| 879 | | TCR 44 - Alpha Native Homo sapiens (aa) |
| 880 | | TCR 44 - Alpha Cysteine-modified Homo sapiens (aa) |
| 881 | | TCR 44 Alpha variable region Homo sapiens (aa) |
| 882 | | TCR 44 Alpha CDR3 Homo sapiens (aa) |
| 883 | | TCR 44 - Beta Native Homo sapiens (aa) |
| 884 | | TCR 44 - Beta Cysteine-modified Homo sapiens (aa) |
| 885 | | TCR 44 - Beta Native Homo sapiens (aa) |
| 886 | | TCR 44 - Beta Cysteine-modified Homo sapiens (aa) |
| 887 | | TCR 44 Beta variable region Homo sapiens (aa) |
| 888 | | TCR 44 Beta CDR3 Homo sapiens (aa) |
| 889 | | TCR 44 Native TCR beta constant region Homo sapiens (aa) |
| 890 | | TCR 44 TCR beta constant region Homo sapiens (aa) |
| 891 | | TCR 45 - Alpha Native Homo sapiens (aa) |
| 892 | | TCR 45 - Alpha Cysteine-modified Homo sapiens (aa) |
| 893 | | TCR 45 - Alpha Native Homo sapiens (aa) |
| 894 | | TCR 45 - Alpha Cysteine-modified Homo sapiens (aa) |

SEQUENCE TABLE-continued

| SEQ ID NO. | SEQUENCE | DESCRIPTION |
|---|---|---|
| 895 | TCR 45 Alpha variable region Homo sapiens (aa) | |
| 896 | TCR 45 Alpha CDR3 Homo sapiens (aa) | |
| 897 | TCR 45 - Beta Native Homo sapiens (aa) | |
| 898 | TCR 45 - Beta Cysteine-modified Homo sapiens (aa) | |
| 899 | TCR 45 - Beta Native Homo sapiens (aa) | |
| 900 | TCR 45 - Beta Cysteine-modified Homo sapiens (aa) | |
| 901 | TCR 45 Beta variable region Homo sapiens (aa) | |
| 902 | TCR 45 Beta CDR3 Homo sapiens (aa) | |
| 903 | TCR 45 Beta signal peptide Homo sapiens (aa) | |
| 904 | TCR 46 - Alpha Native Homo sapiens (aa) | |
| 905 | TCR 46 - Alpha Cysteine-modified Homo sapiens (aa) | |
| 906 | TCR 46 - Alpha Native Homo sapiens (aa) | |
| 907 | TCR 46 - Alpha Cysteine-modified Homo sapiens (aa) | |
| 908 | TCR 46 Alpha variable region Homo sapiens (aa) | |
| 909 | TCR 46 Alpha CDR1 Homo sapiens (aa) | |
| 910 | TCR 46 Alpha CDR2 Homo sapiens (aa) | |
| 911 | TCR 46 Alpha CDR3 Homo sapiens (aa) | |
| 912 | TCR 46 Alpha signal peptide Homo sapiens (aa) | |
| 913 | TCR 46 - Beta Native Homo sapiens (aa) | |
| 914 | TCR 46 - Beta Cysteine-modified Homo sapiens (aa) | |
| 915 | TCR 46 - Beta Native Homo sapiens (aa) | |
| 916 | TCR 46 - Beta Cysteine-modified Homo sapiens (aa) | |
| 917 | TCR 46 Beta variable region Homo sapiens (aa) | |
| 918 | TCR 46 Beta CDR2 Homo sapiens (aa) | |
| 919 | TCR 46 Beta CDR3 Homo sapiens (aa) | |

SEQUENCE TABLE-continued

| SEQ ID NO. | SEQUENCE | DESCRIPTION |
|---|---|---|
| 920 | | TCR 46 Beta signal peptide Homo sapiens (aa) |
| 921 | | TCR 47 - Alpha Native Homo sapiens (aa) |
| 922 | | TCR 47 - Alpha Cysteine-modified Homo sapiens (aa) |
| 923 | | TCR 47 - Alpha Native Homo sapiens (aa) |
| 924 | | TCR 47 - Alpha Cysteine-modified Homo sapiens (aa) |
| 925 | | TCR 47 Alpha variable region Homo sapiens (aa) |
| 926 | | TCR 47 Alpha CDR3 Homo sapiens (aa) |
| 927 | | TCR 47 - Beta Native Homo sapiens (aa) |
| 928 | | TCR 47 - Beta Cysteine-modified Homo sapiens (aa) |
| 929 | | TCR 47 - Beta Native Homo sapiens (aa) |
| 930 | | TCR 47 - Beta Cysteine-modified Homo sapiens (aa) |
| 931 | | TCR 47 Beta variable region Homo sapiens (aa) |
| 932 | | TCR 47 Beta CDR3 Homo sapiens (aa) |
| 933 | | TCR 48 - Alpha Native Homo sapiens (aa) |
| 934 | | TCR 48 - Alpha Cysteine-modified Homo sapiens (aa) |
| 935 | | TCR 48 - Alpha Native Homo sapiens (aa) |
| 936 | | TCR 48 - Alpha Cysteine-modified Homo sapiens (aa) |
| 937 | | TCR 48 Alpha variable region Homo sapiens (aa) |
| 938 | | TCR 48 Alpha CDR1 Homo sapiens (aa) |
| 939 | | TCR 48 Alpha CDR2 Homo sapiens (aa) |
| 940 | | TCR 48 Alpha CDR3 Homo sapiens (aa) |
| 941 | | TCR 48 - Beta Native Homo sapiens (aa) |
| 942 | | TCR 48 - Beta Cysteine-modified Homo sapiens (aa) |
| 943 | | TCR 48 - Beta Native Homo sapiens (aa) |

SEQUENCE TABLE-continued

| SEQ ID NO. | SEQUENCE | DESCRIPTION |
|---|---|---|
| 944 | TCR 48 - Beta Cysteine-modified | Homo sapiens (aa) |
| 945 | TCR 48 Beta variable region | Homo sapiens (aa) |
| 946 | TCR 48 Beta CDR3 | Homo sapiens (aa) |
| 947 | TCR 49 - Alpha Native | Homo sapiens (aa) |
| 948 | TCR 49 - Alpha Cysteine-modified | Homo sapiens (aa) |
| 949 | TCR 49 - Alpha Native | Homo sapiens (aa) |
| 950 | TCR 49 - Alpha Cysteine-modified | Homo sapiens (aa) |
| 951 | TCR 49 Alpha variable region | Homo sapiens (aa) |
| 952 | TCR 49 Alpha CDR3 | Homo sapiens (aa) |
| 953 | TCR 49 - Beta Native | Homo sapiens (aa) |
| 954 | TCR 49 - Beta Cysteine-modified | Homo sapiens (aa) |
| 955 | TCR 49 - Beta Native | Homo sapiens (aa) |
| 956 | TCR 49 - Beta Cysteine-modified | Homo sapiens (aa) |
| 957 | TCR 49 Beta variable region | Homo sapiens (aa) |
| 958 | TCR 49 Beta CDR3 | Homo sapiens (aa) |
| 959 | TCR 50 - Alpha Native | Homo sapiens (aa) |
| 960 | TCR 50 - Alpha Cysteine-modified | Homo sapiens (aa) |
| 961 | TCR 50 - Alpha Native | Homo sapiens (aa) |
| 962 | TCR 50 - Alpha Cysteine-modified | Homo sapiens (aa) |
| 963 | TCR 50 Alpha variable region | Homo sapiens (aa) |
| 964 | TCR 50 Alpha CDR3 | Homo sapiens (aa) |
| 965 | TCR 50 - Beta Native | Homo sapiens (aa) |
| 966 | TCR 50 - Beta Cysteine-modified | Homo sapiens (aa) |
| 967 | TCR 50 - Beta Native | Homo sapiens (aa) |
| 968 | TCR 50 - Beta Cysteine-modified | Homo sapiens (aa) |

SEQUENCE TABLE-continued

| SEQ ID NO. | SEQUENCE | DESCRIPTION |
|---|---|---|
| 969 | TCR 50 Beta variable region Homo sapiens (aa) | |
| 970 | TCR 50 Beta CDR3 Homo sapiens (aa) | |
| 971 | TCR 51 - Alpha Native Homo sapiens (aa) | |
| 972 | TCR 51 - Alpha Cysteine-modified Homo sapiens (aa) | |
| 973 | TCR 51 - Alpha Native Homo sapiens (aa) | |
| 974 | TCR 51 - Alpha Cysteine-modified Homo sapiens (aa) | |
| 975 | TCR 51 Alpha variable region Homo sapiens (aa) | |
| 976 | TCR 51 Alpha CDR3 Homo sapiens (aa) | |
| 977 | TCR 51 - Beta Native Homo sapiens (aa) | |
| 978 | TCR 51 - Beta Cysteine-modified Homo sapiens (aa) | |
| 979 | TCR 51 - Beta Native Homo sapiens (aa) | |
| 980 | TCR 51 - Beta Cysteine-modified Homo sapiens (aa) | |
| 981 | TCR 51 Beta variable region Homo sapiens (aa) | |
| 982 | TCR 51 Beta CDR3 Homo sapiens (aa) | |
| 983 | TCR 52 - Alpha Native Homo sapiens (aa) | |
| 984 | TCR 52 - Alpha Cysteine-modified Homo sapiens (aa) | |
| 985 | TCR 52 - Alpha Native Homo sapiens (aa) | |
| 986 | TCR 52 - Alpha Cysteine-modified Homo sapiens (aa) | |
| 987 | TCR 52 Alpha variable region Homo sapiens (aa) | |
| 988 | TCR 52 Alpha CDR3 Homo sapiens (aa) | |
| 989 | TCR 52 - Beta Native Homo sapiens (aa) | |
| 990 | TCR 52 - Beta Cysteine-modified Homo sapiens (aa) | |
| 991 | TCR 52 - Beta Native Homo sapiens (aa) | |
| 992 | TCR 52 - Beta Cysteine-modified Homo sapiens (aa) | |

SEQUENCE TABLE-continued

| SEQ ID NO. | SEQUENCE | DESCRIPTION |
|---|---|---|
| 993 | TCR 52 | Beta variable region Homo sapiens (aa) |
| 994 | TCR 52 | Beta CDR3 Homo sapiens (aa) |
| 995 | TCR 53 - | Alpha Native Homo sapiens (aa) |
| 996 | TCR 53 - | Alpha Cysteine-modified Homo sapiens (aa) |
| 997 | TCR 53 - | Alpha Native Homo sapiens (aa) |
| 998 | TCR 53 - | Alpha Cysteine-modified Homo sapiens (aa) |
| 999 | TCR 53 | Alpha variable region Homo sapiens (aa) |
| 1000 | TCR 53 | Alpha CDR1 Homo sapiens (aa) |
| 1001 | TCR 53 | Alpha CDR2 Homo sapiens (aa) |
| 1002 | TCR 53 | Alpha CDR3 Homo sapiens (aa) |
| 1003 | TCR 53 | Alpha signal peptide Homo sapiens (aa) |
| 1004 | TCR 53 - | Beta Native Homo sapiens (aa) |
| 1005 | TCR 53 - | Beta Cysteine-modified Homo sapiens (aa) |
| 1006 | TCR 53 - | Beta Native Homo sapiens (aa) |
| 1007 | TCR 53 - | Beta Cysteine-modified Homo sapiens (aa) |
| 1008 | TCR 53 | Beta variable region Homo sapiens (aa) |
| 1009 | TCR 53 | Beta CDR2 Homo sapiens (aa) |
| 1010 | TCR 53 | Beta CDR3 Homo sapiens (aa) |
| 1011 | TCR 53 | Beta signal peptide Homo sapiens (aa) |
| 1012 | Mouse alpha constant Mus musculus (aa) | |
| 1013 | Mouse beta constant Mus musculus (aa) | |
| 1014 | Mouse alpha constant Mus musculus (aa) | |
| 1015 | Mouse alpha constant Mus musculus (aa) | |
| 1016 | Mouse beta constant Mus musculus (aa) | |
| 1017 | Mouse beta constant Cysteine-substituted Mus musculus (aa) | |

SEQUENCE TABLE-continued

| SEQ ID NO. | SEQUENCE | DESCRIPTION |
|---|---|---|
| 1018 | | Mouse alpha constant Transmembrane modified Mus musculus (aa) |
| 1019 | | TCR 17 - Alpha Native Homo sapiens (nt) |
| 1020 | | TCR 17 - Beta Native Homo sapiens (nt) |
| 1021 | | TCR 18 - Alpha Native Homo sapiens (nt) |
| 1022 | | TCR 18 - Beta Native Homo sapiens (nt) |
| 1023 | | TCR 19 - Alpha Native Homo sapiens (nt) |
| 1024 | | TCR 19 - Beta Native Homo sapiens (nt) |
| 1025 | | TCR 20 - Alpha Native Homo sapiens (nt) |
| 1026 | | TCR 20 - Beta Native Homo sapiens (nt) |
| 1027 | | TCR 21 - Alpha Native Homo sapiens (nt) |
| 1028 | | TCR 21 - Beta Native Homo sapiens (nt) |
| 1029 | | TCR 22 - Alpha Native Homo sapiens (nt) |
| 1030 | | TCR 22 - Beta Native Homo sapiens (nt) |
| 1031 | | TCR 23 - Alpha Native Homo sapiens (nt) |
| 1032 | | TCR 23 - Beta Native Homo sapiens (nt) |
| 1033 | | TCR 24 - Alpha Native Homo sapiens (nt) |
| 1034 | | TCR 24 - Beta Native Homo sapiens (nt) |
| 1035 | | TCR 25 - Alpha Native Homo sapiens (nt) |
| 1036 | | TCR 25 - Beta Native Homo sapiens (nt) |
| 1037 | | TCR 26 - Alpha Native Homo sapiens (nt) |
| 1038 | | TCR 26 - Beta Native Homo sapiens (nt) |
| 1039 | | TCR 27 - Alpha Native Homo sapiens (nt) |
| 1040 | | TCR 27 - Beta Native Homo sapiens (nt) |
| 1041 | | TCR 28 - Alpha Native Homo sapiens (nt) |

| SEQ ID NO. | SEQUENCE | DESCRIPTION |
|---|---|---|
| 1042 | TCR 28 - Beta Native Homo sapiens (nt) | |
| 1043 | TCR 29 - Alpha Native Homo sapiens (nt) | |
| 1044 | TCR 29 - Beta Native Homo sapiens (nt) | |
| 1045 | TCR 30 - Alpha Native Homo sapiens (nt) | |
| 1046 | TCR 30 - Beta Native Homo sapiens (nt) | |
| 1047 | Human TCR beta constant 2 (TRBC2) NCBI Reference Sequence: NG_001333.2, TRBC2 | |
| 1048 | TRAC gRNA targeting domain | |
| 1049 | TCR 32 - Alpha Native Homo sapiens (nt) | |
| 1050 | TCR 32 - Beta Native Homo sapiens (nt) | |
| 1051 | TCR 33 - Alpha Native Homo sapiens (nt) | |
| 1052 | TCR 33 - Beta Native Homo sapiens (nt) | |
| 1053 | TRBC gRNA targeting domain | |
| 1054 | TRBC target sequence Homo sapiens (nt) | |
| 1055 | TCR 35 - Alpha Native Homo sapiens (nt) | |
| 1056 | TCR 35 - Beta Native Homo sapiens (nt) | |
| 1057 | TCR 36 - Alpha Native Homo sapiens (nt) | |
| 1058 | TCR 36 - Beta Native Homo sapiens (nt) | |
| 1059 | TCR 37 - Alpha Native Homo sapiens (nt) | |
| 1060 | TCR 37 - Beta Native Homo sapiens (nt) | |
| 1061 | TCR 38 - Alpha Native Homo sapiens (nt) | |
| 1062 | TCR 38 - Beta Native Homo sapiens (nt) | |
| 1063 | TCR 39 - Alpha Native Homo sapiens (nt) | |
| 1064 | TCR 39 - Beta Native Homo sapiens (nt) | |
| 1065 | TCR 40 - Alpha Native Homo sapiens (nt) | |
| 1066 | TCR 40 - Beta Native Homo sapiens (nt) | |

SEQUENCE TABLE-continued

| SEQ ID NO. | SEQUENCE | DESCRIPTION |
|---|---|---|
| 1067 | TCR 41 - Alpha Native | Homo sapiens (nt) |
| 1068 | TCR 41 - Beta Native | Homo sapiens (nt) |
| 1069 | TCR 42 - Alpha Native | Homo sapiens (nt) |
| 1070 | TCR 42 - Beta Native | Homo sapiens (nt) |
| 1071 | TCR 43 - Alpha Native | Homo sapiens (nt) |
| 1072 | TCR 43 - Beta Native | Homo sapiens (nt) |
| 1073 | TCR 44 - Alpha Native | Homo sapiens (nt) |
| 1074 | TCR 44 - Beta Native | Homo sapiens (nt) |
| 1075 | TCR 45 - Alpha Native | Homo sapiens (nt) |
| 1076 | TCR 45 - Beta Native | Homo sapiens (nt) |
| 1077 | TCR 46 - Alpha Native | Homo sapiens (nt) |
| 1078 | TCR 46 - Beta Native | Homo sapiens (nt) |
| 1079 | TCR 47 - Alpha Native | Homo sapiens (nt) |
| 1080 | TCR 47 - Beta Native | Homo sapiens (nt) |
| 1081 | TCR 48 - Alpha Native | Homo sapiens (nt) |
| 1082 | TCR 48 - Beta Native | Homo sapiens (nt) |
| 1083 | TCR 49 - Alpha Native | Homo sapiens (nt) |
| 1084 | TCR 49 - Beta Native | Homo sapiens (nt) |
| 1085 | TCR 50 - Alpha Native | Homo sapiens (nt) |
| 1086 | TCR 50 - Beta Native | Homo sapiens (nt) |
| 1087 | TCR 51 - Alpha Native | Homo sapiens (nt) |
| 1088 | TCR 51 - Beta Native | Homo sapiens (nt) |
| 1089 | TCR 52 - Alpha Native | Homo sapiens (nt) |
| 1090 | TCR 52 - Beta Native | Homo sapiens (nt) |

SEQUENCE TABLE-continued

| SEQ ID NO. | SEQUENCE | DESCRIPTION |
|---|---|---|
| 1091 | TCR 53 - Alpha Native Homo sapiens (nt) | |
| 1092 | TCR 53 - Beta Native Homo sapiens (nt) | |
| 1093 | TCR 54 - Alpha Native Homo sapiens (nt) | |
| 1094 | TCR 54 - Beta Native Homo sapiens (nt) | |
| 1095 | TCR 55 - Alpha Native Homo sapiens (nt) | |
| 1096 | TCR 50/ TCR 54 P2A Artificial (nt) | |
| 1097 | TCR 15 Codon-optimized/ cysteine-modified alpha Homo sapiens (nt) | |
| 1098 | TCR 15 Codon-optimized/ cysteine-modified beta Homo sapiens (nt) | |
| 1099 | TCR 16 Codon-optimized/ cysteine-modified alpha Homo sapiens (nt) | |
| 1100 | TCR 16 Codon-optimized/ cysteine-modified beta Homo sapiens (nt) | |
| 1101 | TCR 17 Codon-optimized/ cysteine-modified alpha Homo sapiens (nt) | |
| 1102 | TCR 17 Codon-optimized/ cysteine-modified beta Homo sapiens (nt) | |
| 1103 | TCR 18 Codon-optimized/ cysteine-modified alpha Homo sapiens (nt) | |
| 1104 | TCR 18 Codon-optimized/ cysteine-modified beta Homo sapiens (nt) | |
| 1105 | TCR 19 Codon-optimized/ cysteine-modified alpha Homo sapiens (nt) | |
| 1106 | TCR 19 Codon-optimized/ cysteine-modified beta Homo sapiens (nt) | |
| 1107 | TCR 20 Codon-optimized/ cysteine-modified alpha Homo sapiens (nt) | |
| 1108 | TCR 20 Codon-optimized/ cysteine-modified beta Homo sapiens (nt) | |
| 1109 | TCR 21 Codon-optimized/ cysteine-modified alpha Homo sapiens (nt) | |
| 1110 | TCR 21 Codon-optimized/ cysteine-modified beta Homo sapiens (nt) | |
| 1111 | TCR 22 Codon-optimized/ cysteine-modified alpha Homo sapiens (nt) | |
| 1112 | TCR 22 Codon-optimized/ cysteine-modified beta Homo sapiens (nt) | |
| 1113 | TCR 23 Codon-optimized/ cysteine-modified alpha Homo sapiens (nt) | |
| 1114 | TCR 23 Codon-optimized/ cysteine-modified beta Homo sapiens (nt) | |
| 1115 | TCR 24 Codon-optimized/ cysteine-modified alpha Homo sapiens (nt) | |

SEQUENCE TABLE-continued

| SEQ ID NO. | SEQUENCE | DESCRIPTION |
|---|---|---|
| 1116 | TCR 24 | Codon-optimized/ cysteine-modified beta Homo sapiens (nt) |
| 1117 | TCR 25 | Codon-optimized/ cysteine-modified alpha Homo sapiens (nt) |
| 1118 | TCR 25 | Codon-optimized/ cysteine-modified beta Homo sapiens (nt) |
| 1119 | TCR 26 | Codon-optimized/ cysteine-modified alpha Homo sapiens (nt) |
| 1120 | TCR 26 | Codon-optimized/ cysteine-modified beta Homo sapiens (nt) |
| 1121 | TCR 27 | Codon-optimized/ cysteine-modified alpha Homo sapiens (nt) |
| 1122 | TCR 27 | Codon-optimized/ cysteine-modified beta Homo sapiens (nt) |
| 1123 | TCR 28 | Codon-optimized/ cysteine-modified alpha Homo sapiens (nt) |
| 1124 | TCR 28 | Codon-optimized/ cysteine-modified beta Homo sapiens (nt) |
| 1125 | TCR 29 | Codon-optimized/ cysteine-modified alpha Homo sapiens (nt) |
| 1126 | TCR 29 | Codon-optimized/ cysteine-modified beta Homo sapiens (nt) |
| 1127 | TCR 30 | Codon-optimized/ cysteine-modified alpha Homo sapiens (nt) |
| 1128 | TCR 30 | Codon-optimized/ cysteine-modified beta Homo sapiens (nt) |
| 1129 | TCR 31 | Codon-optimized/ cysteine-modified alpha Homo sapiens (nt) |
| 1130 | TCR 31 | Codon-optimized/ cysteine-modified beta Homo sapiens (nt) |
| 1131 | TCR 32 | Codon-optimized/ cysteine-modified alpha Homo sapiens (nt) |
| 1132 | TCR 32 | Codon-optimized/ cysteine-modified beta Homo sapiens (nt) |
| 1133 | TCR 33 | Codon-optimized/ cysteine-modified alpha Homo sapiens (nt) |
| 1134 | TCR 33 | Codon-optimized/ cysteine-modified beta Homo sapiens (nt) |
| 1135 | TCR 34 | Codon-optimized/ cysteine-modified alpha Homo sapiens (nt) |
| 1136 | TCR 34 | Codon-optimized/ cysteine-modified beta Homo sapiens (nt) |
| 1137 | TCR 35 | Codon-optimized/ cysteine-modified alpha Homo sapiens (nt) |
| 1138 | TCR 35 | Codon-optimized/ cysteine-modified beta Homo sapiens (nt) |
| 1139 | TCR 36 | Codon-optimized/ cysteine-modified alpha Homo sapiens (nt) |

SEQUENCE TABLE-continued

| SEQ ID NO. | SEQUENCE | DESCRIPTION |
|---|---|---|
| 1140 | TCR 36 | Codon-optimized/cysteine-modified beta Homo sapiens (nt) |
| 1141 | TCR 37 | Codon-optimized/cysteine-modified alpha Homo sapiens (nt) |
| 1142 | TCR 37 | Codon-optimized/cysteine-modified beta Homo sapiens (nt) |
| 1143 | TCR 38 | Codon-optimized/cysteine-modified alpha Homo sapiens (nt) |
| 1144 | TCR 38 | Codon-optimized/cysteine-modified beta Homo sapiens (nt) |
| 1145 | TCR 39 | Codon-optimized/cysteine-modified alpha Homo sapiens (nt) |
| 1146 | TCR 39 | Codon-optimized/cysteine-modified beta Homo sapiens (nt) |
| 1147 | TCR 40 | Codon-optimized/cysteine-modified alpha Homo sapiens (nt) |
| 1148 | TCR 40 | Codon-optimized/cysteine-modified beta Homo sapiens (nt) |
| 1149 | TCR 41 | Codon-optimized/cysteine-modified alpha Homo sapiens (nt) |
| 1150 | TCR 41 | Codon-optimized/cysteine-modified beta Homo sapiens (nt) |
| 1151 | TCR 42 | Codon-optimized/cysteine-modified alpha Homo sapiens (nt) |
| 1152 | TCR 42 | Codon-optimized/cysteine-modified beta Homo sapiens (nt) |
| 1153 | TCR 43 | Codon-optimized/cysteine-modified alpha Homo sapiens (nt) |
| 1154 | TCR 43 | Codon-optimized/cysteine-modified beta Homo sapiens (nt) |
| 1155 | TCR 44 | Codon-optimized/cysteine-modified alpha Homo sapiens (nt) |
| 1156 | TCR 44 | Codon-optimized/cysteine-modified beta Homo sapiens (nt) |
| 1157 | TCR 45 | Codon-optimized/cysteine-modified alpha Homo sapiens (nt) |
| 1158 | TCR 45 | Codon-optimized/cysteine-modified beta Homo sapiens (nt) |
| 1159 | TCR 46 | Codon-optimized/cysteine-modified alpha Homo sapiens (nt) |
| 1160 | TCR 46 | Codon-optimized/cysteine-modified beta Homo sapiens (nt) |
| 1161 | TCR 47 | Codon-optimized/cysteine-modified alpha Homo sapiens (nt) |
| 1162 | TCR 47 | Codon-optimized/cysteine-modified beta Homo sapiens (nt) |
| 1163 | TCR 48 | Codon-optimized/cysteine-modified alpha Homo sapiens (nt) |
| 1164 | TCR 48 | Codon-optimized/cysteine-modified beta Homo sapiens (nt) |

SEQUENCE TABLE-continued

| SEQ ID NO. | SEQUENCE | DESCRIPTION |
|---|---|---|
| 1165 | TCR 49 | Codon-optimized/ cysteine-modified alpha Homo sapiens (nt) |
| 1166 | TCR 49 | Codon-optimized/ cysteine-modified beta Homo sapiens (nt) |
| 1167 | TCR 50 | Codon-optimized/ cysteine-modified alpha Homo sapiens (nt) |
| 1168 | TCR 50 | Codon-optimized/ cysteine-modified beta Homo sapiens (nt) |
| 1169 | TCR 51 | Codon-optimized/ cysteine-modified alpha Homo sapiens (nt) |
| 1170 | TCR 51 | Codon-optimized/ cysteine-modified beta Homo sapiens (nt) |
| 1171 | TCR 52 | Codon-optimized/ cysteine-modified alpha Homo sapiens (nt) |
| 1172 | TCR 52 | Codon-optimized/ cysteine-modified beta Homo sapiens (nt) |
| 1173 | TCR 53 | Codon-optimized/ cysteine-modified alpha Homo sapiens (nt) |
| 1174 | TCR 53 | Codon-optimized/ cysteine-modified beta Homo sapiens (nt) |
| 1175 | TCR 54 | Codon-optimized/ cysteine-modified alpha Homo sapiens (nt) |
| 1176 | TCR 54 | Codon-optimized/ cysteine-modified beta Homo sapiens (nt) |
| 1177 | TCR 55 | Codon-optimized/ cysteine-modified alpha Homo sapiens (nt) |
| 1178 | TCR 55 | Codon-optimized/ cysteine-modified beta Homo sapiens (nt) |
| 1179 | TCR 15/ TCR 16/ TCR 17/ TCR 18/ TCR 19/ TCR 20/ TCR 21/ TCR22/ TCR 23/ TCR 24/ TCR 25/ TCR 26/ TCR 27/ TCR 28/ TCR 29/ TCR 30/ TCR 31/ TCR 32/ TCR 33/ TCR 34 P2A Artificial (nt) |
| 1180 | TCR 35/ TCR 36/ TCR 38/ TCR 40/ TCR 41/ TCR 42/ TCR 43/ TCR 44/ TCR 45/ TCR 46/ TCR 47/ TCR 48 P2A Artificial (nt) |
| 1181 | TCR 37/ TCR 39 P2A Artificial (nt) |
| 1182 | TRAC target sequence Homo sapiens (nt) |
| 1183 | TCR alpha E7(11-19) CDR3 consensus |
| 1184 | TCR alpha E7(11-19) CDR3 consensus |
| 1185 | TCR alpha E7(11-19) CDR3 consensus |
| 1186 | TCR alpha E7(11-19) CDR3 consensus |
| 1187 | TCR alpha E7(11-19) CDR3 consensus |

SEQUENCE TABLE-continued

| SEQ ID NO. | SEQUENCE | DESCRIPTION |
|---|---|---|
| 1188 | | TCR alpha E7(11-19) CDR3 consensus |
| 1189 | | TCR alpha E7(11-19) CDR3 consensus |
| 1190 | | TCR alpha E7(11-19) CDR3 consensus |
| 1191 | | TCR alpha E7(11-19) CDR1 consensus |
| 1192 | | TCR alpha E7(11-19) CDR2 consensus |
| 1193 | | TCR beta E7(11-19) CDR3 consensus |
| 1194 | | TCR beta E7(11-19) CDR3 consensus |
| 1195 | | TCR beta E7(11-19) CDR3 consensus |
| 1196 | | TCR beta E7(11-19) CDR3 consensus |
| 1197 | | TCR beta E7(11-19) CDR3 consensus |
| 1198 | | TCR beta E7(11-19) CDR3 consensus |
| 1199 | | TCR beta E7(11-19) CDR3 consensus |
| 1200 | | TCR beta E7(11-19) CDR3 consensus |
| 1201 | | TCR beta E7(11-19) CDR3 consensus |
| 1202 | | TCR beta E7(11-19) CDR3 consensus |
| 1203 | | TCR beta E7(11-19) CDR1 consensus |
| 1204 | | TCR beta E7(11-19) CDR1 consensus |
| 1205 | | TCR alpha E6(29-38) CDR3 consensus |
| 1206 | | TCR alpha E6(29-38) CDR3 consensus |
| 1207 | | TCR alpha E6(29-38) CDR3 consensus |
| 1208 | | TCR alpha E6(29-38) CDR3 consensus |
| 1209 | | TCR alpha E6(29-38) CDR1consensus |
| 1210 | | TCR alpha E6(29-38) CDR2consensus |
| 1211 | | TCR beta E6(29-38) CDR3 consensus |
| 1212 | | TCR beta E6(29-38) CDR3 consensus |

SEQUENCE TABLE-continued

| SEQ ID NO. | SEQUENCE | DESCRIPTION |
|---|---|---|
| 1213 | TCR beta E6(29-38) CDR3 consensus | |
| 1214 | TCR beta E6(29-38) CDR3 consensus | |
| 1215 | TCR beta E6(29-38) CDR3 consensus | |
| 1216 | TCR beta E6(29-38) CDR3 consensus | |
| 1217 | TCR beta E6(29-38) CDR3 consensus | |
| 1218 | TCR beta E6(29-38) CDR3 consensus | |
| 1219 | TCR beta E6(29-38) CDR3 consensus | |
| 1220 | TCR beta E6(29-38) CDR3 consensus | |
| 1221 | TCR beta E6(29-38) CDR3 consensus | |
| 1222 | TCR beta E6(29-38) CDR3 consensus | |
| 1223 | TCR beta E6(29-38) CDR3 consensus | |
| 1224 | TCR 31 - beta Native Homo sapiens (nt) | |
| 1225 | TCR 31 - Alpha Native Homo sapiens (nt) | |
| 1226 | TCR 34 - Alpha Native Homo sapiens (nt) | |
| 1227 | TCR 34 - Beta Native Homo sapiens (nt) | |
| 1228 | TCR 55 - Beta Native Homo sapiens (nt) | |

SEQUENCE LISTING (1228 sequences)

SEQ ID NO: 1 - protein, 606 aa, Homo sapiens
  TCR 14 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASTFWGQRRTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMEKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCASQTGANNLFFGTGTRLTVIPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 2 - protein, 604 aa, Homo sapiens
  TCR 13 Full Sequence Cysteine-Modified
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSPTGTERELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMLLLLVPVLEVIFTLGGTRAQSVTQLDSHVSVSEGTPVLLRCNYSSSYSPSLFWYVQHPNKGLQLLLKYTSAATLVKGINGFEAEFKKSETSFHLTKPSAHMSDAAEYFCVVRGGKLIFGQGTELSVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 3 - protein, 606 aa, Homo sapiens
  TCR 12 / TCR 55Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAVPSGATNKLIFGTGTLLAVQPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 4 - DNA, 66 bp, Artificial Sequence
  TCR 14 P2A
ggctccggcgccacaaacttttctctgctgaagcaggcaggcgatgtggaggagaaccctggacca

SEQ ID NO: 5 - DNA, 66 bp, Artificial Sequence
  TCR 13 P2A
ggaagcggagccaccaacttttccctgctgaagcaggccggcgatgtggaggagaatcctggccca

SEQ ID NO: 6 - DNA, 66 bp, Artificial Sequence
  TCR 12 P2A
ggatctggagccaccaacttctccctgctgaagcaggccggcgatgtggaggagaatcctggccca

SEQ ID NO: 7 - DNA, 930 bp, Homo sapiens
  TCR 14 - Beta Codon-optimized / Cysteine-modified
atgggcatccggctgctgtgcagagtggccttctgttttctggccgtgggcctggtggacgtgaaggtgacccagagctcccggtatctggtgaagagaacaggcgagaaggtgtttctggagtgcgtgcaggacatggatcacgagaacatgttctggtacaggcaggatccaggcctgggcctgagactgatctatttcagctacgatgtgaagatgaaggagaagggcgacatccctgagggctattctgtgagcagggagaagaaggagcggttcagcctgatcctggagtccgcctctaccaaccagacatctatgtacctgtgcgcaagcaccttctggggacagaggagaacagaggccttctttggccagggcaccaggctgacagtggtggaggacctgaataaggtgttcccccctgaggtggccgtgtttgagccatccgaggccgagatctctcacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgatagccgctattgtctgtctagcaggctgcgcgtgtccgccaccttttggcagaacccaaggaatcacttccgctgccaggtgcagttttacggcctgtccgagaatgacgagtggacccaggatagggccaagccagtgacacagatcgtgtctgccgaggcatggggcagagccgactgtggcttcaccagcgtgtcctaccagcagggcgtgctgagcgccaccatcctgtatgagatcctgctgggcaaggccacactgtacgccgtgctggtgtccgccctggtgctgatggccatggtgaagcggaaggacttc

SEQ ID NO: 8 - DNA, 936 bp, Homo sapiens
  TCR 13 - Beta Codon-optimized / cysteine-modified
atgggaaccaggctgctgtgctgggtggtgctgggctttctgggaaccgaccacacaggagcaggcgtgtcccagtctccaaggtacaaggtggccaagagaggccaggatgtggccctgagatgtgaccccatctccggccacgtgtctctgttctggtaccagcaggccctgggacagggaccagagttcctgacatattttcagaacgaggcccagctggataagagcggcctgccttccgacaggttctttgcagagcgcccagagggaagcgtgtccaccctgaagatccagaggacacagcaggaggactccgccgtgtacctgtgcgcaagctcccctaccggaacagagagggagctgttctttggagagggcagccgcctgaccgtgctggaggatctgaagaacgtgttcccccctgaggtggccgtgtttgagcctagcgaggccgagatctcccacacccagaaggccaccctggtgtgcctggcaaccggcttctatccagaccacgtggagctgagctggtgggtgaacggcaaggaggtgcactccggcgtgtgcacagacccacagcccctgaaggagcagcccgccctgaatgatagccgctactgtctgtctagccggctgagagtgtccgccaccttttggcagaaccctaggaatcacttccgctgccaggtgcagttttatggcctgtccgagaacgacgagtggacccaggatcgggccaagcccgtgacacagatcgtgtctgccgaggcatggggcagagccgattgtggcttcacatctgagagctaccagcagggcgtgctgtccgccaccatcctgtacgagatcctgctgggcaaggccacactgtatgccgtgctggtgagcgccctggtgctgatggccatggtgaagaggaaggactctagagga

SEQ ID NO: 9 - DNA, 933 bp, Homo sapiens
  TCR 12 - Beta Codon-optimized / cysteine-modified
atggacacctggctggtgtgctgggccatcttcagcctgctgaaggcaggcctgaccgagcctgaggtgacccagacaccatcccaccaggtgacacagatgggccaggaagtgatcctgcggtgcgtgcctatctccaaccacctgtacttttattggtacagacagatcctgggccagaaggtggagtttctggtgagcttctacaacaatgagatcagcgagaagtccgagatctttgacgatcagttctctgtggagaggcccgacggcagcaacttcaccctgaagatccgctccacaaagctggaggattctgccatgtatttctgcgccagcaccacacggagctcctacgagcagtattttggccctggcaccagactgaccgtgacagaggacctgaagaacgtgttcccccctgaggtggccgtgttcgagccatctgaggccgagatcagccacacccagaaggccaccctggtgtgcctggcaaccggcttctaccccgatcacgtggagctgagctggtgggtgaacggcaaggaggtgcactccggcgtgtgcacagacccacagcccctgaaggagcagcctgccctgaatgatagcagatactgtctgtctagccggctgagagtgtccgccaccttctggcagaacccaaggaatcactttcgctgccaggtgcagttctatggcctgtctgagaacgacgagtggacccaggatagggccaagccagtgacacagatcgtgagcgccgaggcatggggcagagccgattgtggctttacaagcgagtcctatcagcagggcgtgctgtccgccaccatcctgtacgagatcctgctgggcaaggccacactgtatgccgtgctggtgtctgccctggtgctgatggccatggtgaagaggaaggactccagagga

SEQ ID NO: 10 - DNA, 825 bp, Homo sapiens
  TCR 14 - Alpha Codon-optimized / Cysteine-modified
atggagaagaatcctctggccgccccactgctgatcctgtggttccacctggactgcgtgtcctctatcctgaatgtggagcagagcccacagtccctgcacgtgcaggagggcgatagcaccaacttcacatgttcctttcctagctccaacttctacgccctgcactggtaccggtgggagacagccaagagcccagaggccctgttcgtgatgacactgaacggcgacgagaagaagaagggcagaatcagcgccaccctgaatacaaaggagggctactcctatctgtacatcaagggcagccagcccgaggattccgccacctacctgtgcgcctcccagacaggcgccaacaatctgttctttggcaccggcacaaggctgaccgtgatcccttatatccagaacccagaccctgccgtgtaccagctgagggactctaagtctagcgataagagcgtgtgcctgttcaccgactttgattctcagacaaacgtgagccagagcaaggacagcgacgtgtacatcaccgacaagtgcgtgctggatatgagaagcatggactttaagtccaactctgccgtggcctggtctaataagagcgatttcgcctgcgccaacgcctttaacaattccatcatccccgaggatacattctttccatctcccgagtcctcttgtgacgtgaagctggtggagaagagcttcgagacagatacaaacctgaattttcagaacctgagcgtgatcggcttccggatcctgctgctgaaggtggccggcttcaatctgctgatgaccctgagactgtggagctcctga

SEQ ID NO: 11 - DNA, 813 bp, Homo sapiens
  TCR 13 - Alpha Codon-optimized / cysteine-modified
atgctgctgctgctggtgccagtgctggaagtgatcttcaccctgggaggaacaagggcacagtctgtgacccagctggacagccacgtgtccgtgtctgagggcacacccgtgctgctgagatgcaactactcctctagctatagcccctccctgttttggtacgtgcagcaccctaataagggcctgcagctgctgctgaagtatacctccgccgccacactggtgaagggcatcaatggcttcgaggccgagtttaagaagagcgagacaagcttccacctgacaaagccttccgcccacatgtctgacgccgccgagtacttttgcgtggtgcggggaggcaagctgatcttcggacagggaaccgagctgagcgtgaagccaaacatccagaatcccgatcctgccgtgtatcagctgcgcgactccaagtcctctgataagagcgtgtgcctgttcaccgactttgattctcagacaaacgtgtctcagagcaaggacagcgacgtgtacatcaccgacaagtgcgtgctggatatgcggagcatggactttaagtccaactctgccgtggcctggtctaataagagcgatttcgcctgcgccaatgcctttaacaattccatcatccccgaggatacattctttccatctcccgagagctcctgtgacgtgaagctggtggagaagagcttcgagacagatacaaacctgaattttcagaacctgagcgtgatcggcttcaggatcctgctgctgaaggtggccggcttcaatctgctgatgaccctgcgcctgtggtctagctga

SEQ ID NO: 12 - DNA, 822 bp, Homo sapiens
  TCR 12 - Alpha Codon-optimized / Cysteine-modified
atgaagacatttgccggcttctcttttctgttcctgtggctgcagctggattgcatgagcaggggcgaggacgtggagcagagcctgttcctgtccgtgcgcgagggcgattcctctgtgatcaactgtacctacacagacagctcctctacctatctgtactggtataagcaggagccaggagcaggcctgcagctgctgacctatatcttttccaacatggacatgaagcaggatcagcggctgacagtgctgctgaataagaaggacaagcacctgagcctgagaatcgctgacacccagacaggcgattccgccatctacttctgcgccgtgccctctggcgccaccaataagctgatctttggaaccggcacactgctggcagtgcagcctaacatccagaatcccgatcctgccgtgtaccagctgcgggacagcaagagctccgataagtccgtgtgcctgtttaccgacttcgattctcagacaaacgtgtctcagagcaaggacagcgacgtgtacatcaccgacaagtgcgtgctggatatgcggagcatggacttcaagtccaactctgccgtggcctggtctaataagagcgactttgcctgcgccaatgccttcaacaattccatcatccccgaggatacattctttccatctcccgagtctagctgtgacgtgaagctggtggagaagagcttcgagacagatacaaacctgaatttccagaacctgtctgtgatcggctttaggatcctgctgctgaaggtggccggctttaatctgctgatgaccctgcgcctgtggtcctcttga

SEQ ID NO: 13 - DNA, 1821 bp, Homo sapiens
  TCR 14 Codon-optimized / cysteine-modified full sequence
atgggcatccggctgctgtgcagagtggccttctgttttctggccgtgggcctggtggacgtgaaggtgacccagagctcccggtatctggtgaagagaacaggcgagaaggtgtttctggagtgcgtgcaggacatggatcacgagaacatgttctggtacaggcaggatccaggcctgggcctgagactgatctatttcagctacgatgtgaagatgaaggagaagggcgacatccctgagggctattctgtgagcagggagaagaaggagcggttcagcctgatcctggagtccgcctctaccaaccagacatctatgtacctgtgcgcaagcaccttctggggacagaggagaacagaggccttctttggccagggcaccaggctgacagtggtggaggacctgaataaggtgttcccccctgaggtggccgtgtttgagccatccgaggccgagatctctcacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgatagccgctattgtctgtctagcaggctgcgcgtgtccgccaccttttggcagaacccaaggaatcacttccgctgccaggtgcagttttacggcctgtccgagaatgacgagtggacccaggatagggccaagccagtgacacagatcgtgtctgccgaggcatggggcagagccgactgtggcttcaccagcgtgtcctaccagcagggcgtgctgagcgccaccatcctgtatgagatcctgctgggcaaggccacactgtacgccgtgctggtgtccgccctggtgctgatggccatggtgaagcggaaggacttcggctccggcgccacaaacttttctctgctgaagcaggcaggcgatgtggaggagaaccctggaccaatggagaagaatcctctggccgccccactgctgatcctgtggttccacctggactgcgtgtcctctatcctgaatgtggagcagagcccacagtccctgcacgtgcaggagggcgatagcaccaacttcacatgttcctttcctagctccaacttctacgccctgcactggtaccggtgggagacagccaagagcccagaggccctgttcgtgatgacactgaacggcgacgagaagaagaagggcagaatcagcgccaccctgaatacaaaggagggctactcctatctgtacatcaagggcagccagcccgaggattccgccacctacctgtgcgcctcccagacaggcgccaacaatctgttctttggcaccggcacaaggctgaccgtgatcccttatatccagaacccagaccctgccgtgtaccagctgagggactctaagtctagcgataagagcgtgtgcctgttcaccgactttgattctcagacaaacgtgagccagagcaaggacagcgacgtgtacatcaccgacaagtgcgtgctggatatgagaagcatggactttaagtccaactctgccgtggcctggtctaataagagcgatttcgcctgcgccaacgcctttaacaattccatcatccccgaggatacattctttccatctcccgagtcctcttgtgacgtgaagctggtggagaagagcttcgagacagatacaaacctgaattttcagaacctgagcgtgatcggcttccggatcctgctgctgaaggtggccggcttcaatctgctgatgaccctgagactgtggagctcctga

SEQ ID NO: 14 - DNA, 1815 bp, Homo sapiens
  TCR 13 Codon-optimized / Cysteine-modified Full Sequence
atgggaaccaggctgctgtgctgggtggtgctgggctttctgggaaccgaccacacaggagcaggcgtgtcccagtctccaaggtacaaggtggccaagagaggccaggatgtggccctgagatgtgaccccatctccggccacgtgtctctgttctggtaccagcaggccctgggacagggaccagagttcctgacatattttcagaacgaggcccagctggataagagcggcctgccttccgacaggttctttgcagagcgcccagagggaagcgtgtccaccctgaagatccagaggacacagcaggaggactccgccgtgtacctgtgcgcaagctcccctaccggaacagagagggagctgttctttggagagggcagccgcctgaccgtgctggaggatctgaagaacgtgttcccccctgaggtggccgtgtttgagcctagcgaggccgagatctcccacacccagaaggccaccctggtgtgcctggcaaccggcttctatccagaccacgtggagctgagctggtgggtgaacggcaaggaggtgcactccggcgtgtgcacagacccacagcccctgaaggagcagcccgccctgaatgatagccgctactgtctgtctagccggctgagagtgtccgccaccttttggcagaaccctaggaatcacttccgctgccaggtgcagttttatggcctgtccgagaacgacgagtggacccaggatcgggccaagcccgtgacacagatcgtgtctgccgaggcatggggcagagccgattgtggcttcacatctgagagctaccagcagggcgtgctgtccgccaccatcctgtacgagatcctgctgggcaaggccacactgtatgccgtgctggtgagcgccctggtgctgatggccatggtgaagaggaaggactctagaggaggaagcggagccaccaacttttccctgctgaagcaggccggcgatgtggaggagaatcctggcccaatgctgctgctgctggtgccagtgctggaagtgatcttcaccctgggaggaacaagggcacagtctgtgacccagctggacagccacgtgtccgtgtctgagggcacacccgtgctgctgagatgcaactactcctctagctatagcccctccctgttttggtacgtgcagcaccctaataagggcctgcagctgctgctgaagtatacctccgccgccacactggtgaagggcatcaatggcttcgaggccgagtttaagaagagcgagacaagcttccacctgacaaagccttccgcccacatgtctgacgccgccgagtacttttgcgtggtgcggggaggcaagctgatcttcggacagggaaccgagctgagcgtgaagccaaacatccagaatcccgatcctgccgtgtatcagctgcgcgactccaagtcctctgataagagcgtgtgcctgttcaccgactttgattctcagacaaacgtgtctcagagcaaggacagcgacgtgtacatcaccgacaagtgcgtgctggatatgcggagcatggactttaagtccaactctgccgtggcctggtctaataagagcgatttcgcctgcgccaatgcctttaacaattccatcatccccgaggatacattctttccatctcccgagagctcctgtgacgtgaagctggtggagaagagcttcgagacagatacaaacctgaattttcagaacctgagcgtgatcggcttcaggatcctgctgctgaaggtggccggcttcaatctgctgatgaccctgcgcctgtggtctagctga

SEQ ID NO: 15 - DNA, 1821 bp, Homo sapiens
  TCR 12 Codon-optimized / Cysteine-modified Full Sequence
atggacacctggctggtgtgctgggccatcttcagcctgctgaaggcaggcctgaccgagcctgaggtgacccagacaccatcccaccaggtgacacagatgggccaggaagtgatcctgcggtgcgtgcctatctccaaccacctgtacttttattggtacagacagatcctgggccagaaggtggagtttctggtgagcttctacaacaatgagatcagcgagaagtccgagatctttgacgatcagttctctgtggagaggcccgacggcagcaacttcaccctgaagatccgctccacaaagctggaggattctgccatgtatttctgcgccagcaccacacggagctcctacgagcagtattttggccctggcaccagactgaccgtgacagaggacctgaagaacgtgttcccccctgaggtggccgtgttcgagccatctgaggccgagatcagccacacccagaaggccaccctggtgtgcctggcaaccggcttctaccccgatcacgtggagctgagctggtgggtgaacggcaaggaggtgcactccggcgtgtgcacagacccacagcccctgaaggagcagcctgccctgaatgatagcagatactgtctgtctagccggctgagagtgtccgccaccttctggcagaacccaaggaatcactttcgctgccaggtgcagttctatggcctgtctgagaacgacgagtggacccaggatagggccaagccagtgacacagatcgtgagcgccgaggcatggggcagagccgattgtggctttacaagcgagtcctatcagcagggcgtgctgtccgccaccatcctgtacgagatcctgctgggcaaggccacactgtatgccgtgctggtgtctgccctggtgctgatggccatggtgaagaggaaggactccagaggaggatctggagccaccaacttctccctgctgaagcaggccggcgatgtggaggagaatcctggcccaatgaagacatttgccggcttctcttttctgttcctgtggctgcagctggattgcatgagcaggggcgaggacgtggagcagagcctgttcctgtccgtgcgcgagggcgattcctctgtgatcaactgtacctacacagacagctcctctacctatctgtactggtataagcaggagccaggagcaggcctgcagctgctgacctatatcttttccaacatggacatgaagcaggatcagcggctgacagtgctgctgaataagaaggacaagcacctgagcctgagaatcgctgacacccagacaggcgattccgccatctacttctgcgccgtgccctctggcgccaccaataagctgatctttggaaccggcacactgctggcagtgcagcctaacatccagaatcccgatcctgccgtgtaccagctgcgggacagcaagagctccgataagtccgtgtgcctgtttaccgacttcgattctcagacaaacgtgtctcagagcaaggacagcgacgtgtacatcaccgacaagtgcgtgctggatatgcggagcatggacttcaagtccaactctgccgtggcctggtctaataagagcgactttgcctgcgccaatgccttcaacaattccatcatccccgaggatacattctttccatctcccgagtctagctgtgacgtgaagctggtggagaagagcttcgagacagatacaaacctgaatttccagaacctgtctgtgatcggctttaggatcctgctgctgaaggtggccggctttaatctgctgatgaccctgcgcctgtggtcctcttga

SEQ ID NO: 16 - DNA, 933 bp, Homo sapiens
  TCR 14 - Beta Native
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcaccttctggggacagcgaaggactgaagctttctttggacaaggcaccagactcacagttgtagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctga

SEQ ID NO: 17 - DNA, 939 bp, Homo sapiens
  TCR 13 - Beta Native
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagcccgacagggactgagagggagctgttttttggagaaggctctaggctgaccgtactggaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 18 - protein, 255 aa, Homo sapiens
  TCR 3 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGFKTIFGAGTRLFVKANIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 19 - protein, 255 aa, Homo sapiens
  TCR 3 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGFKTIFGAGTRLFVKANIQKPDPAVYQLRDSKSSDKSVCLFTDFDSQTNVSQSKDSDVYITDKCVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 20 - DNA, 816 bp, Homo sapiens
  TCR 3 - Alpha Native
atgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctcttctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagaggggcgaggcttcaaaactatctttggagcaggaacaagactatttgttaaagcaaatatccagaagcctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagcagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 21 - DNA, 825 bp, Homo sapiens
  TCR 3 - Alpha Codon-optimized / Cysteine-modified
atgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctcttctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagaggggcgaggcttcaaaactatctttggagcaggaacaagactatttgttaaagcaaatatccagaagcctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagcagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcc

SEQ ID NO: 22 - protein, 294 aa, Homo sapiens
  TCR 3 - Beta Native
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSHLAGFTGELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 23 - protein, 294 aa, Homo sapiens
  TCR 3 - Beta Cysteine-modified
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSHLAGFTGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 24 - DNA, 939 bp, Homo sapiens
  TCR 3 - Beta Native
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagccacctcgccgggttcaccggggagctgttttttggagaaggctctaggctgaccgtactggaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 25 - DNA, 939 bp, Homo sapiens
  TCR 3 - Beta Codon-optimized / Cysteine-modified
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagccacctcgccgggttcaccggggagctgttttttggagaaggctctaggctgaccgtactggaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 26 - DNA, 1853 bp, Homo sapiens
  TCR 3 Codon-optimized / Cysteine-modified Full Sequence
gcggccgccaccatgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagccacctcgccgggttcaccggggagctgttttttggagaaggctctaggctgaccgtactggaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcggatccggagctaccaacttctctctgctgaaacaggcaggcgatgtggaggaaaatcctgggccaatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctcttctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagaggggcgaggcttcaaaactatctttggagcaggaacaagactatttgttaaagcaaatatccagaagcctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagcagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcctaaggcgcgcc

SEQ ID NO: 27 - protein, 610 aa, Homo sapiens
  TCR 3 Full Sequence Cysteine-modified
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSHLAGFTGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGFKTIFGAGTRLFVKANIQKPDPAVYQLRDSKSSDKSVCLFTDFDSQTNVSQSKDSDVYITDKCVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 28 - protein, 254 aa, Homo sapiens
  TCR 4 - (E6) 29 Alpha Native
DAKTTQPNSMESNEEEPVHLPCNHSTISGTDYIHWYRQLPSQGPEYVIHGLTSNVNNRMASLAIAEDRKSSTLILHRATLRDAAVYYCILLVIRGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 29 - protein, 254 aa, Homo sapiens
  TCR 4 - (E6)29 Alpha Cysteine-modified
DAKTTQPNSMESNEEEPVHLPCNHSTISGTDYIHWYRQLPSQGPEYVIHGLTSNVNNRMASLAIAEDRKSSTLILHRATLRDAAVYYCILLVIRGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 30 - DNA, 804 bp, Homo sapiens
  TCR 4 - (E6)29 Alpha Native
atgaagttggtgacaagcattactgtactcctatctttgggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctactggtaatccgtggtactagctatggaaagctgacatttggacaagggaccatcttgactgtccatccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 31 - DNA, 813 bp, Homo sapiens
  TCR 4 - (E6)29 Alpha Codon-optimized / Cysteine-modified
atgaaactggtgaccagcatcacagtcctgctgtccctgggaattatgggcgacgccaagaccacacagcctaactctatggagagtaatgaggaagagcctgtgcacctgccatgtaaccattcaactatcagcggcaccgattacattcactggtatcggcagctgccctcccagggacctgaatacgtgatccatggcctgacctcaaatgtcaacaatcgcatggctagcctggctatcgcagaggaccgaaagtcaagcaccctgattctgcaccgagccacactgcgagatgcagccgtgtactattgcatcctgctggtcattagagggaccagctacggaaaactgacatttggccaggggactatcctgaccgtgcatcctaacattcagaatcccgaccctgccgtgtatcagctgagggactctaagtcctctgataaaagcgtgtgcctgttcactgactttgattcccagaccaacgtgtcccagtctaaggactctgacgtgtacatcacagacaaatgcgtcctggatatgcgcagcatggacttcaagagtaactcagccgtggcttggtccaacaagtctgatttcgcatgcgccaacgcttttaacaacagtatcatcccagaagataccttctttccatcacccgagagttcatgtgacgtgaagctggtcgaaaaatctttcgagactgataccaacctgaattttcagaacctgagtgtgatcgggttcaggattctgctgctgaaggtcgccggattcaatctgctgatgacactgcgcctgtggagctcc

SEQ ID NO: 32 - protein, 291 aa, Homo sapiens
  TCR 4 - (E6)29 Beta Native
DTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSPGGGNTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 33 - protein, 291 aa, Homo sapiens
  TCR 4 - (E6)29 Beta Cysteine-modified
DTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSPGGGNTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 34 - DNA, 930 bp, Homo sapiens
  TCR 4 - (E6)29 Beta Native
atgggcaccagcctcctctgctggatggccctgtgtctcctgggggcagatcacgcagatactggagtctcccaggaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagccccggcggggggaacactgaagctttctttggacaaggcaccagactcacagttgtagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttc

SEQ ID NO: 35 - DNA, 930 bp, Homo sapiens
  TCR 4 - (E6)29 Beta  Codon-optimized / Cysteine-modified
atggggactagcctgctgtgctggatggcactgtgcctgctgggagcagaccacgcagataccggagtgagccaggacccaagacataagatcacaaaaaggggccagaacgtgacttttagatgcgatcccattagcgaacacaatagactgtactggtataggcagacactgggacagggaccagagttcctgacttactttcagaacgaagctcagctggagaagagtcgcctgctgtcagaccggttcagcgccgagcgaccaaaaggctctttcagtacactggaaatccagcgaactgagcagggggattccgccatgtatctgtgcgctagctccccaggaggaggaaacaccgaagccttctttggacagggcacacggctgactgtggtcgaggacctgaataaggtgttcccccctgaagtggccgtctttgagccttccgaagctgagatttctcacacccagaaagccaccctggtgtgcctggcaacaggcttctttccagatcacgtggaactgagctggtgggtcaacggaaaggaggtgcatagcggcgtctgcactgacccacagcccctgaaagagcagcccgcactgaatgatagcaggtactgcctgtctagtcggctgagagtgtccgccaccttttggcagaaccctaggaatcatttccgctgtcaggtgcagttttatggcctgtccgaaaacgacgagtggactcaggatcgggccaagcccgtgacccagatcgtctctgcagaagcctggggcagagctgactgcgggttcacctcagtgagctaccagcagggagtcctgtccgctaccatcctgtacgagattctgctgggcaaggctacactgtatgcagtgctggtctctgcactggtgctgatggccatggtcaagcgcaaagacttc

SEQ ID NO: 36 - DNA, 1832 bp, Homo sapiens
  TCR 4 - (E6)29  Codon-optimized / Cysteine-modified Full Sequence
gcggccgccaccatggggactagcctgctgtgctggatggcactgtgcctgctgggagcagaccacgcagataccggagtgagccaggacccaagacataagatcacaaaaaggggccagaacgtgacttttagatgcgatcccattagcgaacacaatagactgtactggtataggcagacactgggacagggaccagagttcctgacttactttcagaacgaagctcagctggagaagagtcgcctgctgtcagaccggttcagcgccgagcgaccaaaaggctctttcagtacactggaaatccagcgaactgagcagggggattccgccatgtatctgtgcgctagctccccaggaggaggaaacaccgaagccttctttggacagggcacacggctgactgtggtcgaggacctgaataaggtgttcccccctgaagtggccgtctttgagccttccgaagctgagatttctcacacccagaaagccaccctggtgtgcctggcaacaggcttctttccagatcacgtggaactgagctggtgggtcaacggaaaggaggtgcatagcggcgtctgcactgacccacagcccctgaaagagcagcccgcactgaatgatagcaggtactgcctgtctagtcggctgagagtgtccgccaccttttggcagaaccctaggaatcatttccgctgtcaggtgcagttttatggcctgtccgaaaacgacgagtggactcaggatcgggccaagcccgtgacccagatcgtctctgcagaagcctggggcagagctgactgcgggttcacctcagtgagctaccagcagggagtcctgtccgctaccatcctgtacgagattctgctgggcaaggctacactgtatgcagtgctggtctctgcactggtgctgatggccatggtcaagcgcaaagacttcgggagtggagcaacaaacttttcactgctgaagcaggccggcgatgtggaggaaaatcctgggccaatgaaactggtgaccagcatcacagtcctgctgtccctgggaattatgggcgacgccaagaccacacagcctaactctatggagagtaatgaggaagagcctgtgcacctgccatgtaaccattcaactatcagcggcaccgattacattcactggtatcggcagctgccctcccagggacctgaatacgtgatccatggcctgacctcaaatgtcaacaatcgcatggctagcctggctatcgcagaggaccgaaagtcaagcaccctgattctgcaccgagccacactgcgagatgcagccgtgtactattgcatcctgctggtcattagagggaccagctacggaaaactgacatttggccaggggactatcctgaccgtgcatcctaacattcagaatcccgaccctgccgtgtatcagctgagggactctaagtcctctgataaaagcgtgtgcctgttcactgactttgattcccagaccaacgtgtcccagtctaaggactctgacgtgtacatcacagacaaatgcgtcctggatatgcgcagcatggacttcaagagtaactcagccgtggcttggtccaacaagtctgatttcgcatgcgccaacgcttttaacaacagtatcatcccagaagataccttctttccatcacccgagagttcatgtgacgtgaagctggtcgaaaaatctttcgagactgataccaacctgaattttcagaacctgagtgtgatcgggttcaggattctgctgctgaaggtcgccggattcaatctgctgatgacactgcgcctgtggagctcctgaggcgcgcc

SEQ ID NO: 37 - protein, 603 aa, Homo sapiens
  TCR 4 - (E6)29 Full Sequence Cysteine-modified
MGTSLLCWMALCLLGADHADTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSPGGGNTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILLVIRGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 38 - protein, 258 aa, Homo sapiens
  TCR 5 - (E6)29 - TCR Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGTGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 39 - protein, 258 aa, Homo sapiens
  TCR 5 - (E6)29 - TCR Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGTGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 40 - DNA, 825 bp, Homo sapiens
  TCR 5 - (E6)29 - TCR Alpha Native
atgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctattctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagagggcacaggtactagctatggaaagctgacatttggacaagggaccatcttgactgtccatccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 41 - DNA, 834 bp, Homo sapiens
  TCR 5 - (E6)29 - TCR Alpha Codon-optimized / Cysteine-modified
atgagtctgtcctctctgctgaaggtggtcactgcatcactgtggctgggaccaggaatcgcacagaaaattacccagacacagcctggcatgtttgtccaggagaaggaagccgtgaccctggactgtacttacgacaccagcgatcagtcctacgggctgttttggtataagcagccaagttcaggagagatgatcttcctgatctaccagggcagctatgacgagcagaacgctacagaaggcaggtatagcctgaatttccagaaagcccgcaagtccgctaacctggtcatctctgccagtcagctgggggattctgccatgtacttttgcgctatgagggagggaactggcaccagctatggaaagctgaccttcgggcagggaacaatcctgactgtccatcccaacattcagaatccagaccctgccgtgtaccagctgcgagacagtaaaagctccgataagagcgtgtgcctgttcacagactttgattctcagactaacgtgagccagagcaaagacagtgatgtctatattaccgacaagtgcgtgctggatatgcgcagcatggactttaaatccaactctgcagtggcctggtctaataagagtgatttcgcttgcgcaaacgcctttaacaattcaatcattcccgaggataccttctttccaagccccgaatctagttgtgacgtgaaactggtggagaagtctttcgaaacagatactaacctgaattttcagaatctgagtgtcatcgggttccggattctgctgctgaaggtggccggattcaacctgctgatgaccctgagactgtggtcaagc

SEQ ID NO: 42 - protein, 291 aa, Homo sapiens
  TCR 5 - (E6)29 - TCR Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSPWGETHQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 43 - protein, 291 aa, Homo sapiens
  TCR 5 - (E6)29 - TCR Beta  Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSPWGETHQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 44 - DNA, 930 bp, Homo sapiens
  TCR 5 - (E6)29 - TCR Beta Native
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagcccatggggagaaactcatcagccccagcattttggtgatgggactcgactctccatcctagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttc

SEQ ID NO: 45 - DNA, 930 bp, Homo sapiens
  TCR 5 - (E6)29 - TCR Beta Codon-optimized / Cysteine-modified
atgggaatcaggctgctgtgccgcgtcgcattctgttttctggccgtgggcctggtggacgtgaaagtgactcagagctccagatacctggtgaaaaggaccggcgagaaggtctttctggaatgcgtgcaggacatggatcacgagaatatgttctggtatcggcaggatccaggcctggggctgagactgatctacttttcctatgatgtgaagatgaaagagaagggcgacattcccgaagggtactccgtgtctcgcgagaagaaagaacgattcagcctgatcctggagagtgcttcaaccaatcagacatccatgtatctgtgcgcatctagtccttggggcgagacacaccagccacagcatttcggagatggcactcggctgagcatcctggaagacctgaacaaagtgttcccccctgaggtcgccgtgttcgaaccttcagaggcagaaattagccacactcagaaggccaccctggtgtgcctggccactggcttctttccagaccacgtcgagctgtcctggtgggtgaatgggaaagaagtccatagtggagtgtgcaccgacccacagcccctgaaggagcagcccgcactgaacgattccagatactgcctgtcaagccggctgagagtgtctgccactttttggcagaaccctcgaaatcatttccggtgtcaggtgcagttttatggcctgagcgagaacgacgaatggacccaggatcgagccaaacctgtcacacagatcgtgtccgccgaggcttggggacgcgctgattgcggcttcacaagcgtctcctaccagcagggcgtgctgtctgccaccatcctgtacgaaattctgctggggaaggctacactgtatgccgtgctggtgagcgccctggtgctgatggcaatggtgaaaaggaaggacttc

SEQ ID NO: 46 - DNA, 1853 bp, Homo sapiens
  TCR 5 - (E6)29 - TCR Codon-optimized / Cysteine-modified Full Sequence
gcggccgccaccatgggaatcaggctgctgtgccgcgtcgcattctgttttctggccgtgggcctggtggacgtgaaagtgactcagagctccagatacctggtgaaaaggaccggcgagaaggtctttctggaatgcgtgcaggacatggatcacgagaatatgttctggtatcggcaggatccaggcctggggctgagactgatctacttttcctatgatgtgaagatgaaagagaagggcgacattcccgaagggtactccgtgtctcgcgagaagaaagaacgattcagcctgatcctggagagtgcttcaaccaatcagacatccatgtatctgtgcgcatctagtccttggggcgagacacaccagccacagcatttcggagatggcactcggctgagcatcctggaagacctgaacaaagtgttcccccctgaggtcgccgtgttcgaaccttcagaggcagaaattagccacactcagaaggccaccctggtgtgcctggccactggcttctttccagaccacgtcgagctgtcctggtgggtgaatgggaaagaagtccatagtggagtgtgcaccgacccacagcccctgaaggagcagcccgcactgaacgattccagatactgcctgtcaagccggctgagagtgtctgccactttttggcagaaccctcgaaatcatttccggtgtcaggtgcagttttatggcctgagcgagaacgacgaatggacccaggatcgagccaaacctgtcacacagatcgtgtccgccgaggcttggggacgcgctgattgcggcttcacaagcgtctcctaccagcagggcgtgctgtctgccaccatcctgtacgaaattctgctggggaaggctacactgtatgccgtgctggtgagcgccctggtgctgatggcaatggtgaaaaggaaggacttcgggtccggagccacaaatttttctctgctgaaacaggctggcgatgtggaggaaaaccctgggccaatgagtctgtcctctctgctgaaggtggtcactgcatcactgtggctgggaccaggaatcgcacagaaaattacccagacacagcctggcatgtttgtccaggagaaggaagccgtgaccctggactgtacttacgacaccagcgatcagtcctacgggctgttttggtataagcagccaagttcaggagagatgatcttcctgatctaccagggcagctatgacgagcagaacgctacagaaggcaggtatagcctgaatttccagaaagcccgcaagtccgctaacctggtcatctctgccagtcagctgggggattctgccatgtacttttgcgctatgagggagggaactggcaccagctatggaaagctgaccttcgggcagggaacaatcctgactgtccatcccaacattcagaatccagaccctgccgtgtaccagctgcgagacagtaaaagctccgataagagcgtgtgcctgttcacagactttgattctcagactaacgtgagccagagcaaagacagtgatgtctatattaccgacaagtgcgtgctggatatgcgcagcatggactttaaatccaactctgcagtggcctggtctaataagagtgatttcgcttgcgcaaacgcctttaacaattcaatcattcccgaggataccttctttccaagccccgaatctagttgtgacgtgaaactggtggagaagtctttcgaaacagatactaacctgaattttcagaatctgagtgtcatcgggttccggattctgctgctgaaggtggccggattcaacctgctgatgaccctgagactgtggtcaagctgaggcgcgcc

SEQ ID NO: 47 - protein, 610 aa, Homo sapiens
  TCR 5 - (E6)29 - TCR Full Sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGETHQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGTGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 48 - protein, 253 aa, Homo sapiens
  TCR 6 - Alpha Native
GEDVEQSLFLSVREGDSSVINCTYTDSSSTYLYWYKQEPGAGLQLLTYIFSNMDMKQDQRLTVLLNKKDKHLSLRIADTQTGDSAIYFCAESIRGFGNVLHCGSGTQVIVLPHIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 49 - protein, 253 aa, Homo sapiens
  TCR 6 - Alpha Cysteine-modified
GEDVEQSLFLSVREGDSSVINCTYTDSSSTYLYWYKQEPGAGLQLLTYIFSNMDMKQDQRLTVLLNKKDKHLSLRIADTQTGDSAIYFCAESIRGFGNVLHCGSGTQVIVLPHIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 50 - DNA, 813 bp, Homo sapiens
  TCR 6 - Alpha Native
atgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagagtataagaggctttgggaatgtgctgcattgcgggtccggcactcaagtgattgttttaccacatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 51 - DNA, 822 bp, Homo sapiens
  TCR 6 - Alpha Codon-optimized / Cysteine-modified
atgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagagtataagaggctttgggaatgtgctgcattgcgggtccggcactcaagtgattgttttaccacatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcc

SEQ ID NO: 52 - protein, 292 aa, Homo sapiens
  TCR 6, TCR 12 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 53 - protein, 292 aa, Homo sapiens
  TCR 6, TCR 12  - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 54 - DNA, 933 bp, Homo sapiens
  TCR 6 - Beta Codon Optimized / Cysteine Modified
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcacaacgaggagctcctacgagcagtacttcgggccgggcaccaggctcacggtcacagaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtctgcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 55 - DNA, 933 bp, Homo sapiens
  TCR 6 - Beta Native
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcacaacgaggagctcctacgagcagtacttcgggccgggcaccaggctcacggtcacagaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 56 - DNA, 1844 bp, Homo sapiens
  TCR 6 Codon-optimized / Cysteine-modified Full Sequence
gcggccgccaccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcacaacgaggagctcctacgagcagtacttcgggccgggcaccaggctcacggtcacagaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtctgcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcggatccggagctaccaacttctctctgctgaaacaggcaggcgatgtggaggaaaatcctgggccaatgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagagtataagaggctttgggaatgtgctgcattgcgggtccggcactcaagtgattgttttaccacatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcctaaggcgcgcc

SEQ ID NO: 57 - protein, 607 aa, Homo sapiens
  TCR 6 Full Sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESIRGFGNVLHCGSGTQVIVLPHIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 58 - protein, 254 aa, Homo sapiens
  TCR 7/ TCR 54 - (E7)11 - Alpha  Native
KNQVEQSPQSLIILEGKNCTLQCNYTVSPFSNLRWYKQDTGRGPVSLTIMTFSENTKSNGRYTATLDADTKQSSLHITASQLSDSASYICVVSRDNYGQNFVFGPGTRLSVLPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 59 - protein, 254 aa, Homo sapiens
  TCR 7/ TCR 54 - (E7)11 - Alpha Cysteine-modified
KNQVEQSPQSLIILEGKNCTLQCNYTVSPFSNLRWYKQDTGRGPVSLTIMTFSENTKSNGRYTATLDADTKQSSLHITASQLSDSASYICVVSRDNYGQNFVFGPGTRLSVLPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 60 - DNA, 816 bp, Homo sapiens
  TCR 7 - (E7)11 - Alpha Native
atgaaaaagcatctgacgaccttcttggtgattttgtggctttatttttatagggggaatggcaaaaaccaagtggagcagagtcctcagtccctgatcatcctggagggaaagaactgcactcttcaatgcaattatacagtgagccccttcagcaacttaaggtggtataagcaagatactgggagaggtcctgtttccctgacaatcatgactttcagtgagaacacaaagtcgaacggaagatatacagcaactctggatgcagacacaaagcaaagctctctgcacatcacagcctcccagctcagcgattcagcctcctacatctgtgtggtgagccgggataactatggtcagaattttgtctttggtcccggaaccagattgtccgtgctgccctatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 61 - DNA, 825 bp, Homo sapiens
  TCR 7 - (E7)11 - Alpha  Codon-optimized / Cysteine-modified
atgaagaaacacctgaccaccttcctggtcatcctgtggctgtacttctacagagggaacggaaagaatcaggtggaacagagtccacagtcactgatcattctggagggcaaaaactgcactctgcagtgtaattataccgtgagcccattttccaatctgcgatggtacaagcaggacactggacgaggacccgtgagcctgaccattatgacattctccgagaacaccaagtctaatggccgctatacagccactctggacgctgatactaaacagtctagtctgcatatcaccgcctctcagctgtctgatagtgcttcatatatttgcgtggtcagtagggacaactacgggcagaatttcgtgtttggaccaggaacccgactgtccgtcctgccttatatccagaaccccgaccctgccgtgtaccagctgagggactctaagtcaagcgataaaagcgtgtgcctgttcacagactttgattcccagactaatgtgagccagtccaaggactctgacgtgtacattactgacaaatgcgtcctggatatgcgcagcatggactttaagtctaacagtgcagtggcctggtctaacaagagtgatttcgcttgcgcaaacgcctttaacaatagtatcattcccgaagatactttctttccatcacccgagtcctcttgtgacgtgaagctggtcgaaaaatcattcgagaccgatacaaacctgaattttcagaacctgtctgtgatcgggttccggattctgctgctgaaggtcgccggattcaatctgctgatgacactgagactgtggagttca

SEQ ID NO: 62 - protein, 290 aa, Homo sapiens
  TCR 7/ TCR 54 - (E7)11 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCAITDRTNYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 63 - protein, 290 aa, Homo sapiens
  TCR 7/ TCR 54 - (E7)11 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCAITDRTNYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 64 - DNA, 927 bp, Homo sapiens
  TCR 7 - (E7)11 -Beta Native
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccattacagaccgcactaactatggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttc

SEQ ID NO: 65 - DNA, 927 bp, Homo sapiens
  TCR 7 - (E7)11 - Beta Codon-optimized / Cysteine-modified
atggacacctggctggtgtgctgggcaatctttagtctgctgaaggccggactgaccgagcctgaagtgactcagaccccatcccaccaggtcacacagatgggccaggaagtgatcctgcggtgcgtgccaatttccaaccatctgtacttctattggtacagacagattctgggccagaaggtggagttcctggtcagcttttataacaacgagatctcagaaaagagcgagattttcgacgatcagttttcagtggaaagacccgatgggagcaatttcaccctgaagatcaggagtacaaaactggaggattcagcaatgtacttttgcgccattactgaccgcaccaactatggatacaccttcggctccgggacacgactgactgtggtcgaggacctgaataaggtgttcccccctgaagtggctgtctttgagccttcagaggcagaaatcagccacacacagaaagccaccctggtgtgcctggctacaggcttctttccagatcacgtggaactgagctggtgggtcaacggcaaggaggtgcattccggggtctgcactgacccacagcccctgaaagagcagcccgctctgaatgatagcaggtattgcctgagctcccggctgagagtgtccgccaccttttggcagaaccctaggaatcatttccgctgtcaggtgcagttttacggcctgtctgaaaacgacgagtggacccaggatcgagctaagcctgtgacacagatcgtcagcgccgaagcttgggggcgcgcagactgcggattcaccagcgtgtcctaccagcagggcgtcctgtccgccacaatcctgtatgagattctgctggggaaggctactctgtacgcagtgctggtctctgctctggtgctgatggcaatggtcaagcggaaagacttc

SEQ ID NO: 66 - DNA, 1841 bp, Homo sapiens
  TCR 7 - (E7)11 - Codon-optimized / Cysteine-modified Full Sequence
gcggccgccaccatggacacctggctggtgtgctgggcaatctttagtctgctgaaggccggactgaccgagcctgaagtgactcagaccccatcccaccaggtcacacagatgggccaggaagtgatcctgcggtgcgtgccaatttccaaccatctgtacttctattggtacagacagattctgggccagaaggtggagttcctggtcagcttttataacaacgagatctcagaaaagagcgagattttcgacgatcagttttcagtggaaagacccgatgggagcaatttcaccctgaagatcaggagtacaaaactggaggattcagcaatgtacttttgcgccattactgaccgcaccaactatggatacaccttcggctccgggacacgactgactgtggtcgaggacctgaataaggtgttcccccctgaagtggctgtctttgagccttcagaggcagaaatcagccacacacagaaagccaccctggtgtgcctggctacaggcttctttccagatcacgtggaactgagctggtgggtcaacggcaaggaggtgcattccggggtctgcactgacccacagcccctgaaagagcagcccgctctgaatgatagcaggtattgcctgagctcccggctgagagtgtccgccaccttttggcagaaccctaggaatcatttccgctgtcaggtgcagttttacggcctgtctgaaaacgacgagtggacccaggatcgagctaagcctgtgacacagatcgtcagcgccgaagcttgggggcgcgcagactgcggattcaccagcgtgtcctaccagcagggcgtcctgtccgccacaatcctgtatgagattctgctggggaaggctactctgtacgcagtgctggtctctgctctggtgctgatggcaatggtcaagcggaaagacttcggaagcggcgcaacaaacttttccctgctgaaacaggccggagatgtggaggaaaatcctggcccaatgaagaaacacctgaccaccttcctggtcatcctgtggctgtacttctacagagggaacggaaagaatcaggtggaacagagtccacagtcactgatcattctggagggcaaaaactgcactctgcagtgtaattataccgtgagcccattttccaatctgcgatggtacaagcaggacactggacgaggacccgtgagcctgaccattatgacattctccgagaacaccaagtctaatggccgctatacagccactctggacgctgatactaaacagtctagtctgcatatcaccgcctctcagctgtctgatagtgcttcatatatttgcgtggtcagtagggacaactacgggcagaatttcgtgtttggaccaggaacccgactgtccgtcctgccttatatccagaaccccgaccctgccgtgtaccagctgagggactctaagtcaagcgataaaagcgtgtgcctgttcacagactttgattcccagactaatgtgagccagtccaaggactctgacgtgtacattactgacaaatgcgtcctggatatgcgcagcatggactttaagtctaacagtgcagtggcctggtctaacaagagtgatttcgcttgcgcaaacgcctttaacaatagtatcattcccgaagatactttctttccatcacccgagtcctcttgtgacgtgaagctggtcgaaaaatcattcgagaccgatacaaacctgaattttcagaacctgtctgtgatcgggttccggattctgctgctgaaggtcgccggattcaatctgctgatgacactgagactgtggagttcatgaggcgcgcc

SEQ ID NO: 67 - protein, 606 aa, Homo sapiens
  TCR 7/ TCR 54 - (E7)11 - Full Sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITDRTNYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSRDNYGQNFVFGPGTRLSVLPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 68 - protein, 253 aa, Homo sapiens
  TCR 8 - Alpha Native
KQEVTQIPAALSVPEGENLVLNCSFTDSAIYNLQWFRQDPGKGLTSLLLIQSSQREQTSGRLNASLDKSSGRSTLYIAASQPGDSATYLCAVRPLGNTPLVFGKGTRLSVIANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 69 - protein, 253 aa, Homo sapiens
  TCR 8 - Alpha  Cysteine-modified
KQEVTQIPAALSVPEGENLVLNCSFTDSAIYNLQWFRQDPGKGLTSLLLIQSSQREQTSGRLNASLDKSSGRSTLYIAASQPGDSATYLCAVRPLGNTPLVFGKGTRLSVIANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 70 - DNA, 807 bp, Homo sapiens
  TCR 8 - Alpha Native
atggagaccctcttgggcctgcttatcctttggctgcagctgcaatgggtgagcagcaaacaggaggtgacacagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgtgaggcctctcggaaacacacctcttgtctttggaaagggcacaagactttctgtgattgcaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctc

SEQ ID NO: 71 - DNA, 816 bp, Homo sapiens
  TCR 8 - Alpha  Codon-optimized / Cysteine-modified
atggagaccctcttgggcctgcttatcctttggctgcagctgcaatgggtgagcagcaaacaggaggtgacacagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgtgaggcctctcggaaacacacctcttgtctttggaaagggcacaagactttctgtgattgcaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgcgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctctggtcttcc

SEQ ID NO: 72 - protein, 291 aa, Homo sapiens
  TCR 8 - Beta Native
KVTQSSRYLVKRTGEKVFLECVQDMDHENMFWYRQDPGLGLRLIYFSYDVKMKEKGDIPEGYSVSREKKERFSLILESASTNQTSMYLCASSLWGASTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 73 - protein, 291 aa, Homo sapiens
  TCR 8 - Beta Cysteine-modified
KVTQSSRYLVKRTGEKVFLECVQDMDHENMFWYRQDPGLGLRLIYFSYDVKMKEKGDIPEGYSVSREKKERFSLILESASTNQTSMYLCASSLWGASTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 74 - DNA, 936 bp, Homo sapiens
  TCR 8 - Beta Native
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatggggggctagcacagatacgcagtattttggcccaggcacccggctgacagtgctcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 75 - DNA, 936 bp, Homo sapiens
  TCR 8 - Beta Codon-optimized / Cysteine-modified
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatggggggctagcacagatacgcagtattttggcccaggcacccggctgacagtgctcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 76 - DNA, 1841 bp, Homo sapiens
  TCR 8 Codon-optimized / Cysteine-modified Full Sequence
gcggccgccaccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatggggggctagcacagatacgcagtattttggcccaggcacccggctgacagtgctcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcggatccggagctaccaacttctctctgctgaaacaggcaggcgatgtggaggaaaatcctgggccaatggagaccctcttgggcctgcttatcctttggctgcagctgcaatgggtgagcagcaaacaggaggtgacacagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgtgaggcctctcggaaacacacctcttgtctttggaaagggcacaagactttctgtgattgcaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgcgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctctggtcttcctaaggcgcgcc

SEQ ID NO: 77 - protein, 606 aa, Homo sapiens
  TCR 8 Full Sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGASTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMETLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPLGNTPLVFGKGTRLSVIANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 78 - protein, 258 aa, Homo sapiens
  TCR 9 - Alpha Native
AQKITQTQPGMFVQEKEAVTLDCTYDTSDPSYGLFWYKQPSSGEMIFLIYQGSYDQQNATEGRYSLNFQKARKSANLVISASQLGDSAMYFCAMRTAGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 79 - protein, 258 aa, Homo sapiens
  TCR 9 - Alpha Cysteine-modified
AQKITQTQPGMFVQEKEAVTLDCTYDTSDPSYGLFWYKQPSSGEMIFLIYQGSYDQQNATEGRYSLNFQKARKSANLVISASQLGDSAMYFCAMRTAGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 80 - DNA, 825 bp, Homo sapiens
  TCR 9 - Alpha Native
atgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatccaagttatggtctattctggtacaagcagcccagcagtggggaaatgatttttcttatttatcaggggtcttatgaccagcaaaatgcaacagaaggtcgctactcattgaatttccagaaggcaagaaaatccgccaaccttgtcatctccgcttcacaactgggggactcagcaatgtacttctgtgcaatgagaactgctggtggtactagctatggaaagctgacatttggacaagggaccatcttgactgtccatccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 81 - DNA, 834 bp, Homo sapiens
  TCR 9 - Alpha Codon-optimized / Cysteine-modified
atgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatccaagttatggtctattctggtacaagcagcccagcagtggggaaatgatttttcttatttatcaggggtcttatgaccagcaaaatgcaacagaaggtcgctactcattgaatttccagaaggcaagaaaatccgccaaccttgtcatctccgcttcacaactgggggactcagcaatgtacttctgtgcaatgagaactgctggtggtactagctatggaaagctgacatttggacaagggaccatcttgactgtccatccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcc

SEQ ID NO: 82 - protein, 292 aa, Homo sapiens
  TCR 9 - Beta Native
NAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYFGTAYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 83 - protein, 292 aa, Homo sapiens
  TCR 9 - Beta Cysteine-modified
NAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYFGTAYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 84 - DNA, 933 bp, Homo sapiens
  TCR 9 - Beta Native
atgagcctcgggctcctgtgctgtggggccttttctctcctgtgggcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttacttcgggacagcctacgagcagtacttcgggccgggcaccaggctcacggtcacagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 85 - DNA, 933 bp, Homo sapiens
  TCR 9 - Beta Codon-optimized / Cysteine-modified
atgagcctcgggctcctgtgctgtggggccttttctctcctgtgggcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttacttcgggacagcctacgagcagtacttcgggccgggcaccaggctcacggtcacagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 86 - DNA, 1856 bp, Homo sapiens
  TCR 9 - Codon-optimized / Cysteine-modified Full Sequence
gcggccgccaccatgagcctcgggctcctgtgctgtggggccttttctctcctgtgggcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttacttcgggacagcctacgagcagtacttcgggccgggcaccaggctcacggtcacagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcggatccggagctaccaacttctctctgctgaaacaggcaggcgatgtggaggaaaatcctgggccaatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatccaagttatggtctattctggtacaagcagcccagcagtggggaaatgatttttcttatttatcaggggtcttatgaccagcaaaatgcaacagaaggtcgctactcattgaatttccagaaggcaagaaaatccgccaaccttgtcatctccgcttcacaactgggggactcagcaatgtacttctgtgcaatgagaactgctggtggtactagctatggaaagctgacatttggacaagggaccatcttgactgtccatccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcctaaggcgcgcc

SEQ ID NO: 87 - protein, 611 aa, Homo sapiens
  TCR 9 - Full Sequence Cysteine-modified
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYFGTAYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMRTAGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 88 - protein, 258 aa, Homo sapiens
  TCR 10 - Alpha Native
RKEVEQDPGPFNVPEGATVAFNCTYSNSASQSFFWYRQDCRKEPKLLMSVYSSGNEDGRFTAQLNRASQYISLLIRDSKLSDSATYLCVVNFPSRGAGGTSYGKLTFGQGTILTVHPNIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 89 - protein, 258 aa, Homo sapiens
  TCR 10 - Alpha Cysteine-modified
RKEVEQDPGPFNVPEGATVAFNCTYSNSASQSFFWYRQDCRKEPKLLMSVYSSGNEDGRFTAQLNRASQYISLLIRDSKLSDSATYLCVVNFPSRGAGGTSYGKLTFGQGTILTVHPNIQKPDPAVYQLRDSKSSDKSVCLFTDFDSQTNVSQSKDSDVYITDKCVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 90 - DNA, 831 bp, Homo sapiens
  TCR 10 - Alpha Native
atgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaacttcccttctcggggtgctggtggtactagctatggaaagctgacatttggacaagggaccatcttgactgtccatccaaatatccagaagcctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagcagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 91 - DNA, 840 bp, Homo sapiens
  TCR 10 - Alpha Codon-optimized / Cysteine-modified
atgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaacttcccttctcggggtgctggtggtactagctatggaaagctgacatttggacaagggaccatcttgactgtccatccaaatatccagaagcctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagcagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcc

SEQ ID NO: 92 - protein, 291 aa, Homo sapiens
  TCR 10 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSLSLTGNYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 93 - protein, 291 aa, Homo sapiens
  TCR 10 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSLSLTGNYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 94 - DNA, 930 bp, Homo sapiens
  TCR 10 - Beta Native
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatccctaacagggaactatggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttc

SEQ ID NO: 95 - DNA, 930 bp, Homo sapiens
  TCR 10 - Beta Codon-optimized / Cysteine-modified
atgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatccctaacagggaactatggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtctgtacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttc

SEQ ID NO: 96 - DNA, 1859 bp, Homo sapiens
  TCR 10 Codon-optimized / Cysteine-modified Full Sequence
gcggccgccaccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatccctaacagggaactatggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtctgtacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttcggatccggagctaccaacttctctctgctgaaacaggcaggcgatgtggaggaaaatcctgggccaatgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaacttcccttctcggggtgctggtggtactagctatggaaagctgacatttggacaagggaccatcttgactgtccatccaaatatccagaagcctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagcagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcctaaggcgcgcc

SEQ ID NO: 97 - protein, 612 aa, Homo sapiens
  TCR 10 Full Sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLSLTGNYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNFPSRGAGGTSYGKLTFGQGTILTVHPNIQKPDPAVYQLRDSKSSDKSVCLFTDFDSQTNVSQSKDSDVYITDKCVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 98 - protein, 253 aa, Homo sapiens
  TCR 11 - Alpha Native
DAKTTQPNSMESNEEEPVHLPCNHSTISGTDYIHWYRQLPSQGPEYVIHGLTSNVNNRMASLAIAEDRKSSTLILHRATLRDAAVYYCILSAHSNSGYALNFGKGTSLLVTPHIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 99 - protein, 253 aa, Homo sapiens
  TCR 11 - Alpha Cysteine-modified
DAKTTQPNSMESNEEEPVHLPCNHSTISGTDYIHWYRQLPSQGPEYVIHGLTSNVNNRMASLAIAEDRKSSTLILHRATLRDAAVYYCILSAHSNSGYALNFGKGTSLLVTPHIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 100 - DNA, 801 bp, Homo sapiens
  TCR 11 - Alpha Native
atgaagttggtgacaagcattactgtactcctatctttgggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagcgctcactcaaattccgggtatgcactcaacttcggcaaaggcacctcgctgttggtcacaccccatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 101 - DNA, 810 bp, Homo sapiens
  TCR 11 - Alpha Codon-optimized / Cysteine-modified
atgaagttggtgacaagcattactgtactcctatctttgggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagcgctcactcaaattccgggtatgcactcaacttcggcaaaggcacctcgctgttggtcacaccccatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcc

SEQ ID NO: 102 - protein, 297 aa, Homo sapiens
  TCR 11 - Beta Native
SAVISQKPSRDICQRGTSLTIQCQVDSQVTMMFWYRQQPGQSLTLIATANQGSEATYESGFVIDKFPISRPNLTFSTLTVSNMSPEDSSIYLCSVVPWTRGGSTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 103 - protein, 297 aa, Homo sapiens
  TCR 11 - Beta Cysteine-modified
SAVISQKPSRDICQRGTSLTIQCQVDSQVTMMFWYRQQPGQSLTLIATANQGSEATYESGFVIDKFPISRPNLTFSTLTVSNMSPEDSSIYLCSVVPWTRGGSTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 104 - DNA, 936 bp, Homo sapiens
  TCR 11 - Beta Native
atgctgagtcttctgctccttctcctgggactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgtcccttggacgcgcggggggagcacagatacgcagtattttggcccaggcacccggctgacagtgctcgaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 105 - DNA, 936 bp, Homo sapiens
  TCR 11 - Beta Codon-optimized / Cysteine-modified
atgctgagtcttctgctccttctcctgggactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgtcccttggacgcgcggggggagcacagatacgcagtattttggcccaggcacccggctgacagtgctcgaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 106 - DNA, 1835 bp, Homo sapiens
  TCR 11 Codon-optimized / Cysteine-modified Full Sequence
gcggccgccaccatgctgagtcttctgctccttctcctgggactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgtcccttggacgcgcggggggagcacagatacgcagtattttggcccaggcacccggctgacagtgctcgaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtctgtacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcggatccggagctaccaacttctctctgctgaaacaggcaggcgatgtggaggaaaatcctgggccaatgaagttggtgacaagcattactgtactcctatctttgggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagcgctcactcaaattccgggtatgcactcaacttcggcaaaggcacctcgctgttggtcacaccccatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtcttcctaaggcgcgcc

SEQ ID NO: 107 - protein, 604 aa, Homo sapiens
  TCR 11 Full Sequence Cysteine-modified
MLSLLLLLLGLGSVFSAVISQKPSRDICQRGTSLTIQCQVDSQVTMMFWYRQQPGQSLTLIATANQGSEATYESGFVIDKFPISRPNLTFSTLTVSNMSPEDSSIYLCSVVPWTRGGSTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILSAHSNSGYALNFGKGTSLLVTPHIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 108 - DNA, 936 bp, Homo sapiens
  TCR 12 - Beta Native
atggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcacaacgaggagctcctacgagcagtacttcgggccgggcaccaggctcacggtcacagaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 109 - protein, 172 aa, Mus musculus
  Mouse Beta Constant Sequence
DLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYHQGVLSATILYEILLGKATLYAVLVSGLVLMAMVKRKNS

SEQ ID NO: 110 - protein, 312 aa, Homo sapiens
  TCR 8 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGASTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 111 - protein, 114 aa, Homo sapiens
  TCR 3 Alpha Variable Region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGFKTIFGAGTRLFVKA

SEQ ID NO: 112 - protein, 115 aa, Homo sapiens
  TCR 3 Beta Variable Region
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSHLAGFTGELFFGEGSRLTVL

SEQ ID NO: 113 - protein, 113 aa, Homo sapiens
  TCR 4 - (E6)29 Alpha Variable Region
DAKTTQPNSMESNEEEPVHLPCNHSTISGTDYIHWYRQLPSQGPEYVIHGLTSNVNNRMASLAIAEDRKSSTLILHRATLRDAAVYYCILLVIRGTSYGKLTFGQGTILTVHP

SEQ ID NO: 114 - protein, 112 aa, Homo sapiens
  TCR 4 - (E6)29 Beta Variable Region
GVSQDPRHKITKRGQNVTFRCDPISEHNRLYWYRQTLGQGPEFLTYFQNEAQLEKSRLLSDRFSAERPKGSFSTLEIQRTEQGDSAMYLCASSPGGGNTEAFFGQGTRLTVV

SEQ ID NO: 115 - protein, 117 aa, Homo sapiens
  TCR 5 - (E6)29 - TCR Alpha Variable Region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGTGTSYGKLTFGQGTILTVHP

SEQ ID NO: 116 - protein, 112 aa, Homo sapiens
  TCR 5 - (E6)29 - TCR Beta Variable Region
KVTQSSRYLVKRTGEKVFLECVQDMDHENMFWYRQDPGLGLRLIYFSYDVKMKEKGDIPEGYSVSREKKERFSLILESASTNQTSMYLCASSPWGETHQPQHFGDGTRLSIL

SEQ ID NO: 117 - protein, 112 aa, Homo sapiens
  TCR 6 Alpha Variable Region
GEDVEQSLFLSVREGDSSVINCTYTDSSSTYLYWYKQEPGAGLQLLTYIFSNMDMKQDQRLTVLLNKKDKHLSLRIADTQTGDSAIYFCAESIRGFGNVLHCGSGTQVIVLP

SEQ ID NO: 118 - protein, 113 aa, Homo sapiens
  TCR 6, TCR 12 Beta Variable Region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVT

SEQ ID NO: 119 - protein, 113 aa, Homo sapiens
  TCR 7/ TCR 54 - (E7)11 - Alpha Variable Region
KNQVEQSPQSLIILEGKNCTLQCNYTVSPFSNLRWYKQDTGRGPVSLTIMTFSENTKSNGRYTATLDADTKQSSLHITASQLSDSASYICVVSRDNYGQNFVFGPGTRLSVLP

SEQ ID NO: 120 - protein, 113 aa, Homo sapiens
  TCR 7/ TCR 54 - (E7)11 - Beta Variable Region
EPEVTQTPSHQVTQMGQEVILRCVPISNHLYFYWYRQILGQKVEFLVSFYNNEISEKSEIFDDQFSVERPDGSNFTLKIRSTKLEDSAMYFCAITDRTNYGYTFGSGTRLTVV

SEQ ID NO: 121 - protein, 112 aa, Homo sapiens
  TCR 8 Alpha Variable Region
KQEVTQIPAALSVPEGENLVLNCSFTDSAIYNLQWFRQDPGKGLTSLLLIQSSQREQTSGRLNASLDKSSGRSTLYIAASQPGDSATYLCAVRPLGNTPLVFGKGTRLSVIA

SEQ ID NO: 122 - protein, 112 aa, Homo sapiens
  TCR 8 Beta Variable Region
KVTQSSRYLVKRTGEKVFLECVQDMDHENMFWYRQDPGLGLRLIYFSYDVKMKEKGDIPEGYSVSREKKERFSLILESASTNQTSMYLCASSLWGASTDTQYFGPGTRLTVL

SEQ ID NO: 123 - protein, 117 aa, Homo sapiens
  TCR 9 Alpha Variable Region
AQKITQTQPGMFVQEKEAVTLDCTYDTSDPSYGLFWYKQPSSGEMIFLIYQGSYDQQNATEGRYSLNFQKARKSANLVISASQLGDSAMYFCAMRTAGGTSYGKLTFGQGTILTVHP

SEQ ID NO: 124 - protein, 113 aa, Homo sapiens
  TCR 9 Beta Variable Region
NAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYFGTAYEQYFGPGTRLTVT

SEQ ID NO: 125 - protein, 117 aa, Homo sapiens
  TCR 10 Alpha Variable Region
RKEVEQDPGPFNVPEGATVAFNCTYSNSASQSFFWYRQDCRKEPKLLMSVYSSGNEDGRFTAQLNRASQYISLLIRDSKLSDSATYLCVVNFPSRGAGGTSYGKLTFGQGTILTVHP

SEQ ID NO: 126 - protein, 112 aa, Homo sapiens
  TCR 10 Beta Variable Region
KVTQSSRYLVKRTGEKVFLECVQDMDHENMFWYRQDPGLGLRLIYFSYDVKMKEKGDIPEGYSVSREKKERFSLILESASTNQTSMYLCASSLSLTGNYGYTFGSGTRLTVV

SEQ ID NO: 127 - protein, 112 aa, Homo sapiens
  TCR 11 Alpha Variable Region
DAKTTQPNSMESNEEEPVHLPCNHSTISGTDYIHWYRQLPSQGPEYVIHGLTSNVNNRMASLAIAEDRKSSTLILHRATLRDAAVYYCILSAHSNSGYALNFGKGTSLLVTP

SEQ ID NO: 128 - protein, 118 aa, Homo sapiens
  TCR 11 Beta Variable Region
SAVISQKPSRDICQRGTSLTIQCQVDSQVTMMFWYRQQPGQSLTLIATANQGSEATYESGFVIDKFPISRPNLTFSTLTVSNMSPEDSSIYLCSVVPWTRGGSTDTQYFGPGTRLTVL

SEQ ID NO: 129 - protein, 312 aa, Homo sapiens
  TCR 8 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGASTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 130 - protein, 278 aa, Homo sapiens
  TCR 9 - Alpha Native
MSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMRTAGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 131 - protein, 278 aa, Homo sapiens
  TCR 9 - Alpha Cysteine-modified
MSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMRTAGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 132 - protein, 311 aa, Homo sapiens
  TCR 9 - Beta Native
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYFGTAYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 133 - protein, 311 aa, Homo sapiens
  TCR 9 - Beta Cysteine-modified
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYFGTAYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 134 - protein, 280 aa, Homo sapiens
  TCR 10 - Alpha Native
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNFPSRGAGGTSYGKLTFGQGTILTVHPNIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 135 - protein, 280 aa, Homo sapiens
  TCR 10 - Alpha Cysteine-modified
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNFPSRGAGGTSYGKLTFGQGTILTVHPNIQKPDPAVYQLRDSKSSDKSVCLFTDFDSQTNVSQSKDSDVYITDKCVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 136 - protein, 7 aa, Homo sapiens
  TCR 3/ TCR 5/ TCR 15 / TCR 19 / TCR 21 / TCR 23 / TCR 24 / TCR 25 / TCR 26 / TCR 29 - (E6)29 - TCR Alpha CDR1
TSDQSYG

SEQ ID NO: 137 - protein, 8 aa, Homo sapiens
  TCR 3/ TCR 5/ TCR 15 / TCR 19 / TCR 21 / TCR 23 / TCR 25  / TCR 26 / TCR 29 - (E6)29  - TCR Alpha CDR2
QGSYDEQN

SEQ ID NO: 138 - protein, 11 aa, Homo sapiens
  TCR 3 Alpha CDR3
AMREGRGFKTI

SEQ ID NO: 139 - protein, 5 aa, Homo sapiens
  TCR 3 / TCR 13/ TCR 37/ TCR 53 Beta CDR1
SGHVS

SEQ ID NO: 140 - protein, 6 aa, Homo sapiens
  TCR 3/ TCR 4/ TCR 13/ TCR 37 - (E6)29 Beta CDR2
FQNEAQ

SEQ ID NO: 141 - protein, 13 aa, Homo sapiens
  TCR 3 Beta CDR3
ASSHLAGFTGELF

SEQ ID NO: 142 - protein, 7 aa, Homo sapiens
  TCR 4/ TCR 27 - (E6)29/ TCR 11 Alpha CDR1
TISGTDY

SEQ ID NO: 143 - protein, 5 aa, Homo sapiens
  TCR 4/ TCR 27 - (E6)29/ TCR 11 Alpha CDR2
GLTSN

SEQ ID NO: 144 - protein, 14 aa, Homo sapiens
  TCR 4 - (E6)29 Alpha CDR3
ILLVIRGTSYGKLT

SEQ ID NO: 145 - protein, 5 aa, Homo sapiens
  TCR 4 - (E6)29 Beta CDR1
SEHNR

SEQ ID NO: 146 - protein, 12 aa, Homo sapiens
  TCR 4 - (E6)29 Beta CDR3
ASSPGGGNTEAF

SEQ ID NO: 147 - protein, 14 aa, Homo sapiens
  TCR 5 - (E6)29 - TCR Alpha CDR3
AMREGTGTSYGKLT

SEQ ID NO: 148 - protein, 5 aa, Homo sapiens
  TCR 5/ TCR 16/ TCR 17 /TCR 18 /TCR 19 / TCR 23 /TCR 24 /TCR 25 /TCR 28 - (E6)29/ TCR 8 /  TCR 10 / TCR 14 - TCR Beta CDR1
MDHEN

SEQ ID NO: 149 - protein, 6 aa, Homo sapiens
  TCR 5/ TCR 16/ TCR 17/ TCR 18/ TCR 19 / TCR 23/ TCR 24/ TCR 25/ TCR 28- (E6)29 / TCR 8 / TCR 10 / TCR 14 - TCR beta CDR2
SYDVKM

SEQ ID NO: 150 - protein, 13 aa, Homo sapiens
  TCR 5 - (E6)29 - TCR Beta CDR3
ASSPWGETHQPQH

SEQ ID NO: 151 - protein, 6 aa, Homo sapiens
  TCR 6, TCR 12, TCR 50, TCR 55 Alpha CDR1
DSSSTY

SEQ ID NO: 152 - protein, 7 aa, Homo sapiens
  TCR 6, TCR 12, TCR 50, TCR 55 Alpha CDR2
IFSNMDM

SEQ ID NO: 153 - protein, 12 aa, Homo sapiens
  TCR 6 Alpha CDR3
AESIRGFGNVLH

SEQ ID NO: 154 - protein, 5 aa, Homo sapiens
  TCR 6/ TCR 7 - (E7)11, E7(11-19) / TCR 12 Consensus, TCR 30 / TCR 33 / TCR 36 / TCR 39 /TCR 40 / TCR 41 / TCR 42 / TCR 43 / TCR 47 / TCR 48 / TCR 49 / TCR 51 / TCR 54/ TCR 55 Beta CDR1
SNHLY

SEQ ID NO: 155 - protein, 6 aa, Homo sapiens
  TCR 6/ TCR 7 - (E7)11, E7(11-19) / TCR 12 Consensus, TCR 30 / TCR 33 / TCR 36 / TCR 39 / TCR 42 / TCR 43  / TCR 47 / TCR 48 / TCR 49 / TCR 51 / TCR 54/ TCR 55 Beta CDR2
FYNNEI

SEQ ID NO: 156 - protein, 11 aa, Homo sapiens
  TCR 6 / TCR 12/ TCR 55 Beta CDR3
ASTTRSSYEQY

SEQ ID NO: 157 - protein, 6 aa, Homo sapiens
  TCR 7/ TCR 54 Alpha CDR1
VSPFSN

SEQ ID NO: 158 - protein, 7 aa, Homo sapiens
  TCR 7/ TCR 54 - (E7)11 - Alpha CDR2
MTFSENT

SEQ ID NO: 159 - protein, 12 aa, Homo sapiens
  TCR 7/ TCR 54 - (E7)11 - Alpha CDR3
VVSRDNYGQNFV

SEQ ID NO: 160 - protein, 11 aa, Homo sapiens
  TCR 7/ TCR 54 - (E7)11 - Beta CDR3
AITDRTNYGYT

SEQ ID NO: 161 - protein, 6 aa, Homo sapiens
  TCR 8/ TCR 16 / TCR 18 Alpha CDR1
DSAIYN

SEQ ID NO: 162 - protein, 7 aa, Homo sapiens
  TCR 8/ TCR 16 / TCR 18 Alpha CDR2
IQSSQRE

SEQ ID NO: 163 - protein, 11 aa, Homo sapiens
  TCR 8 Alpha CDR3
AVRPLGNTPLV

SEQ ID NO: 164 - protein, 13 aa, Homo sapiens
  TCR 8 Beta CDR3
ASSLWGASTDTQY

SEQ ID NO: 165 - protein, 7 aa, Homo sapiens
  TCR 9 / TCR 17 Alpha CDR1
TSDPSYG

SEQ ID NO: 166 - protein, 8 aa, Homo sapiens
  TCR 9 / TCR 17 Alpha CDR2
QGSYDQQN

SEQ ID NO: 167 - protein, 14 aa, Homo sapiens
  TCR 9 Alpha CDR3
AMRTAGGTSYGKLT

SEQ ID NO: 168 - protein, 5 aa, Homo sapiens
  TCR 9/ TCR 26 Beta CDR1
MNHEY

SEQ ID NO: 169 - protein, 6 aa, Homo sapiens
  TCR 9/ TCR 26 Beta CDR2
SVGEGT

SEQ ID NO: 170 - protein, 12 aa, Homo sapiens
  TCR 9 Beta CDR3
ASSYFGTAYEQY

SEQ ID NO: 171 - protein, 6 aa, Homo sapiens
  TCR 10/ TCR 28/ TCR 36/ TCR 41 Alpha CDR1
NSASQS

SEQ ID NO: 172 - protein, 6 aa, Homo sapiens
  TCR 10/ TCR 28/ TCR 41 Alpha CDR2
VYSSGN

SEQ ID NO: 173 - protein, 18 aa, Homo sapiens
  TCR 10 Alpha CDR3
VVNFPSRGAGGTSYGKLT

SEQ ID NO: 174 - protein, 13 aa, Homo sapiens
  TCR 10 Beta CDR3
ASSLSLTGNYGYT

SEQ ID NO: 175 - protein, 13 aa, Homo sapiens
  TCR 11 Alpha CDR3
ILSAHSNSGYALN

SEQ ID NO: 176 - protein, 5 aa, Homo sapiens
  TCR 11 Beta CDR1
SQVTM

SEQ ID NO: 177 - protein, 7 aa, Homo sapiens
  TCR 11 Beta CDR2
ANQGSEA

SEQ ID NO: 178 - protein, 15 aa, Homo sapiens
  TCR 11 Beta CDR3
SVVPWTRGGSTDTQY

SEQ ID NO: 179 - protein, 310 aa, Homo sapiens
  TCR 10 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLSLTGNYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 180 - protein, 310 aa, Homo sapiens
  TCR 10 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLSLTGNYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 181 - protein, 20 aa, Homo sapiens
  TCR 3/ TCR 9/ TCR 5/ TCR 15/ TCR 17/ TCR 19/ TCR 21/ TCR 23/ TCR 24/ TCR 25/ TCR 26/ TCR 29 - (E6)29 TCR Alpha Signal Peptide
MSLSSLLKVVTASLWLGPGI

SEQ ID NO: 182 - protein, 19 aa, Homo sapiens
  TCR 3 / TCR 13/ TCR 37  - Beta Signal Peptide
MGTRLLCWVVLGFLGTDHT

SEQ ID NO: 183 - DNA, 810 bp, Homo sapiens
  TCR 12 - Alpha Native
atgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagtcccctcgggtgctacaaacaagctcatctttggaactggcactctgcttgctgtccagccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgcgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 184 - protein, 17 aa, Homo sapiens
  TCR 4/ TCR 27 - (E6)29 Alpha Signal Peptide
MKLVTSITVLLSLGIMG

SEQ ID NO: 185 - protein, 21 aa, Homo sapiens
  TCR 4 - (E6)29 Beta Signal Peptide
MGTSLLCWMALCLLGADHADT

SEQ ID NO: 186 - protein, 19 aa, Homo sapiens
  TCR 5/ TCR 16/ TCR 17 / TCR 18/ TCR 19/ TCR 23/ TCR 24/ TCR 25/ TCR 28 - (E6)29/ TCR 8/ TCR10 / TCR 14 - TCR Beta Signal Peptide
MGIRLLCRVAFCFLAVGLV

SEQ ID NO: 187 - protein, 21 aa, Homo sapiens
  TCR 6 / TCR 12/ TCR 50/ TCR 55- Alpha Signal Peptide
MKTFAGFSFLFLWLQLDCMSR

SEQ ID NO: 188 - protein, 19 aa, Homo sapiens
  TCR 6/7/12/33/36/39/43/47/49/51/54/55/30 (E6)29 - Beta Signal  Peptide
MDTWLVCWAIFSLLKAGLT

SEQ ID NO: 189 - protein, 21 aa, Homo sapiens
  TCR 7/ TCR 54 - (E7)11 - Alpha Signal Peptide
MKKHLTTFLVILWLYFYRGNG

SEQ ID NO: 190 - protein, 19 aa, Homo sapiens
  TCR 8/ TCR 16 / TCR 18 - Alpha Signal Peptide
METLLGLLILWLQLQWVSS

SEQ ID NO: 191 - protein, 19 aa, Homo sapiens
  TCR 9/ TCR 26 - Beta Signal Peptide
MSLGLLCCGAFSLLWAGPV

SEQ ID NO: 192 - protein, 22 aa, Homo sapiens
  TCR 10/ TCR 28 / TCR 36 / TCR 41 - Alpha Signal Peptide
MMISLRVLLVILWLQLSWVWSQ

SEQ ID NO: 193 - protein, 17 aa, Homo sapiens
  TCR 11 - Alpha Signal Peptide
MKLVTSITVLLSLGIMG

SEQ ID NO: 194 - protein, 15 aa, Homo sapiens
  TCR 11 - Beta Signal Peptide
MLSLLLLLLGLGSVF

SEQ ID NO: 195 - protein, 270 aa, Homo sapiens
  TCR 11 - Alpha Native
MKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILSAHSNSGYALNFGKGTSLLVTPHIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 196 - protein, 141 aa, Homo sapiens
  TCR 4 - (E6)29 / TCR 5 - (E6)29 / TCR 12/ TCR 55 - TCR Alpha Constant Region
NIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 197 - protein, 177 aa, Homo sapiens
  TCR 4/5/7/10/14/16/17/18/21/22/23/25/27/28/30/37/39/50 /54 - TCR beta constant region
EDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 198 - protein, 141 aa, Homo sapiens
  TCR 3/ TCR 10 TCR Alpha Constant Region
NIQKPDPAVYQLRDSKSSDKSVCLFTDFDSQTNVSQSKDSDVYITDKCVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 199 - protein, 179 aa, Homo sapiens
  TCR 3/ 6/8/9/11/13/19/ 20/24/29/31/32/33/34/ 35/36/38/ 40/41/42/43/ 45/46/47/48/49/51/52/55 - TCR beta constant region
EDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 200 - protein, 141 aa, Homo sapiens
  TCR 6/ TCR 11 Alpha Constant Region
HIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 201 - protein, 141 aa, Homo sapiens
  TCR 7/ TCR 14/ TCR 15 / TCR 20/ TCR 36/ TCR 54 - Alpha Constant Region
YIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 202 - DNA, 801 bp, Homo sapiens
  TCR 13 - Alpha Native
atgctcctgctgctcgtcccagtgctcgaggtgatttttactctgggaggaaccagagcccagtcggtgacccagcttgacagccacgtctctgtctctgaaggaaccccggtgctgctgaggtgcaactactcatcttcttattcaccatctctcttctggtatgtgcaacaccccaacaaaggactccagcttctcctgaagtacacatcagcggccaccctggttaaaggcatcaacggttttgaggctgaatttaagaagagtgaaacctccttccacctgacgaaaccctcagcccatatgagcgacgcggctgagtacttctgtgttgtgaggggaggaaagcttatcttcggacagggaacggagttatctgtgaaacccaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgcgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 203 - protein, 141 aa, Homo sapiens; identical to SEQ ID NO: 196
  TCR 8/9/13/16/17/18/21/26/27/28/30/31/32/33/34/35/37/3 8/39/40/41/42/43/44/45/46/48/49/50/51/52/53 - alpha constant region

SEQ ID NO: 204 - protein, 22 aa, Artificial Sequence
  P2A
GSGATNFSLLKQAGDVEENPGP

SEQ ID NO: 205 - protein, 270 aa, Homo sapiens
  TCR 11 - Alpha Cysteine-modified
MKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILSAHSNSGYALNFGKGTSLLVTPHIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 206 - protein, 312 aa, Homo sapiens
  TCR 11 - Beta Native
MLSLLLLLLGLGSVFSAVISQKPSRDICQRGTSLTIQCQVDSQVTMMFWYRQQPGQSLTLIATANQGSEATYESGFVIDKFPISRPNLTFSTLTVSNMSPEDSSIYLCSVVPWTRGGSTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 207 - DNA, 66 bp, Artificial Sequence
  TCR 3/ TCR 6/ TCR 8/ TCR 9/ TCR 10/TCR 11/ P2A
ggatccggagctaccaacttctctctgctgaaacaggcaggcgatgtggaggaaaatcctgggcca

SEQ ID NO: 208 - DNA, 66 bp, Artificial Sequence
  TCR 4/ P2A
gggagtggagcaacaaacttttcactgctgaagcaggccggcgatgtggaggaaaatcctgggcca

SEQ ID NO: 209 - DNA, 66 bp, Artificial Sequence
  TCR 5/ P2A
gggtccggagccacaaatttttctctgctgaaacaggctggcgatgtggaggaaaaccctgggcca

SEQ ID NO: 210 - DNA, 66 bp, Artificial Sequence
  TCR 7/ P2A
ggaagcggcgcaacaaacttttccctgctgaaacaggccggagatgtggaggaaaatcctggccca

SEQ ID NO: 211 - protein, 18 aa, Artificial Sequence
  T2A
EGRGSLLTCGDVEENPGP

SEQ ID NO: 212 - protein, 141 aa, Homo sapiens
  TCR 3/ TCR 10 Native TCR Alpha onstant Region
NIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 213 - protein, 141 aa, Homo sapiens
  TCR 4/5/12/8/9/13/16/17/18 /21/26/27/28/30/31/32/33/34/35/37/38/39/40 /41/42/43/44/45/46/48/49/50/51/52/53/55 - Native TCR alpha constant region
NIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 214 - protein, 177 aa, Homo sapiens
  TCR 4/5/16/17/18/21/22/23/25/27/28/7/37/39/50/51/52/54 /10/14 - Native TCR beta constant region
EDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 215 - protein, 142 aa, Homo sapiens
  TCR 3/ TCR 10 Native TCR Alpha Constant Region
PNIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 216 - protein, 179 aa, Homo sapiens
  TCR 3/6/12/8/9/11/13/19/20/24/29/31/32/33/34/35/36/38/ 40/41/42/43/46/47/48/49/53/55 Native TCR beta constant region
EDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 217 - protein, 141 aa, Homo sapiens
  TCR 6/ TCR 11 Native TCR Alpha Constant Region
HIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 218 - protein, 141 aa, Homo sapiens
  TCR 7/ TCR 14/ TCR 15/ TCR 20/ TCR 36/ TCR 54 - Native TCR Alpha Constant Region
YIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 219 - DNA, 813 bp, Homo sapiens
  TCR 14 - Alpha Native
atggagaagaatcctttggcagccccattactaatcctctggtttcatcttgactgcgtgagcagcatactgaacgtggaacaaagtcctcagtcactgcatgttcaggagggagacagcaccaatttcacctgcagcttcccttccagcaatttttatgccttacactggtacagatgggaaactgcaaaaagccccgaggccttgtttgtaatgactttaaatggggatgaaaagaagaaaggacgaataagtgccactcttaataccaaggagggttacagctatttgtacatcaaaggatcccagcctgaagactcagccacatacctctgtgcctctcaaactggggcaaacaacctcttctttgggactggaacgagactcaccgttattccctatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctg

SEQ ID NO: 220 - protein, 142 aa, Homo sapiens
  TCR 4 - (E6)29 / TCR 5 / TCR 12 /TCR 8/ TCR 9 / TCR 13- (E6)29 - Native TCR Alpha Constant Region
PNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 221 - protein, 312 aa, Homo sapiens
  TCR 11 - Beta Cysteine-modified
MLSLLLLLLGLGSVFSAVISQKPSRDICQRGTSLTIQCQVDSQVTMMFWYRQQPGQSLTLIATANQGSEATYESGFVIDKFPISRPNLTFSTLTVSNMSPEDSSIYLCSVVPWTRGGSTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 222 - protein, 273 aa, Homo sapiens
  TCR 12/ TCR 55 - (E7)11 - Alpha Native
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAVPSGATNKLIFGTGTLLAVQPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 223 - protein, 610 aa, Homo sapiens
  TCR 3 Full Sequence Native
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSHLAGFTGELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGFKTIFGAGTRLFVKANIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 224 - protein, 603 aa, Homo sapiens
  TCR 4 - (E6)29 Full Sequence Native
MGTSLLCWMALCLLGADHADTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSPGGGNTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILLVIRGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 225 - protein, 610 aa, Homo sapiens
  TCR 5 - (E6)29 - TCR Full Sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGETHQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGTGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 226 - protein, 607 aa, Homo sapiens
  TCR 6 Full Sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESIRGFGNVLHCGSGTQVIVLPHIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 227 - protein, 606 aa, Homo sapiens
  TCR 7/ TCR 54 - (E7)11 - Full Sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITDRTNYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSRDNYGQNFVFGPGTRLSVLPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 228 - protein, 606 aa, Homo sapiens
  TCR 8 Full Sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGASTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMETLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPLGNTPLVFGKGTRLSVIANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 229 - protein, 611 aa, Homo sapiens
  TCR 9 - Full Sequence Native
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYFGTAYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMRTAGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 230 - protein, 612 aa, Homo sapiens
  TCR 10 Full Sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLSLTGNYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNFPSRGAGGTSYGKLTFGQGTILTVHPNIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 231 - protein, 604 aa, Homo sapiens
  TCR 11 Full Sequence Native
MLSLLLLLLGLGSVFSAVISQKPSRDICQRGTSLTIQCQVDSQVTMMFWYRQQPGQSLTLIATANQGSEATYESGFVIDKFPISRPNLTFSTLTVSNMSPEDSSIYLCSVVPWTRGGSTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILSAHSNSGYALNFGKGTSLLVTPHIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 232 - protein, 9 aa, Human papillomavirus
  E6(18-26) Peptide
KLPQLCTEL

SEQ ID NO: 233 - protein, 10 aa, Human papillomavirus
  E6(29-38) Peptide
TIHDIILECV

SEQ ID NO: 234 - protein, 9 aa, Human papillomavirus
  E6(52-60) Peptide
FAFRDLCIV

SEQ ID NO: 235 - protein, 8 aa, Human papillomavirus
  E7(86-93) Peptide
TLGIVCPI

SEQ ID NO: 236 - protein, 9 aa, Human papillomavirus
  E7(11-19) Peptide
YMLDLQPET

SEQ ID NO: 237 - protein, 9 aa, Human papillomavirus
  E7(85-93) Peptide
GTLGIVCPI

SEQ ID NO: 238 - protein, 9 aa, Human papillomavirus
  E7(82-90) Peptide
LLMGTLGIV

SEQ ID NO: 239 - protein, 9 aa, Human papillomavirus
  E7(7-15) Peptide
TLHEYMLDL

SEQ ID NO: 240 - protein, 7 aa, Artificial Sequence
  TCR Alpha E6(29-38) CDR1 Consensus
  VARIANT (1)...(1): X1 = T, D, S, or N
  VARIANT (2)...(2): X2 = I, or S
  VARIANT (3)...(3): X3 = S, D, N, Y, or A
  VARIANT (4)...(4): X4 = G, Q, P, or null
  VARIANT (5)...(5): X5 = T, S, F, or I
  VARIANT (6)...(6): X6 = D, Y, P, or Q
  VARIANT (7)...(7): X7 = Y, G, N, A, S, or Q
XXXXXXX

SEQ ID NO: 241 - protein, 6 aa, Artificial Sequence
  TCR Alpha E7(11-19) CDR1 Consensus
  VARIANT (1)...(1): X1 = D or V
  VARIANT (3)...(3): X3 = S, or P
  VARIANT (4)...(4): X4 = S or F
  VARIANT (5)...(5): X5 = T or S
  VARIANT (6)...(6): X6 = Y or N
XSXXXX

SEQ ID NO: 242 - protein, 273 aa, Homo sapiens
  TCR 12 / TCR 55 - (E7)11  - Alpha Cysteine-modified
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAVPSGATNKLIFGTGTLLAVQPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 243 - protein, 7 aa, Artificial Sequence
  TCR Alpha Overall CDR1 Consensus
  VARIANT (1)...(1): X1 = T, D, N, S, or V
  VARIANT (2)...(2): X2 = I or S
  VARIANT (3)...(3): X3 = S, D, A, P, N, or Y
  VARIANT (4)...(4): X4 = G, Q, P, or null
  VARIANT (5)...(5): X5 = T, S, I, or F
  VARIANT (6)...(6): X6 = D, Y, ,Q, T, P, or S
  VARIANT (7)...(7): X7 = Y, G, N, A, S, or Q
XXXXXXX

SEQ ID NO: 244 - protein, 8 aa, Artificial Sequence
  TCR Alpha E6(29-38) CDR2 Consensus
  VARIANT (1)...(1): X1 = G, Q, I, M, Y, or V
  VARIANT (2)...(2): X2 = L, S, Q, T, or Y
  VARIANT (3)...(3): X3 = T, G, L, or S
  VARIANT (4)...(4): X4 = Y, S, N, A, or null
  VARIANT (5)...(5): X5 = null, A, or D
  VARIANT (6)...(6): X6 = null, E, Q, T, or S
  VARIANT (7)...(7): X7 = S, Q, R, L, or G
  VARIANT (8)...(8): X8 = N, V, or E
XXXXXXXX

SEQ ID NO: 245 - protein, 7 aa, Artificial Sequence
  TCR Alpha E7(11-19) CDR2 Consensus
  VARIANT (1)...(1): X1 = I or M
  VARIANT (2)...(2): X2 = F or T
  VARIANT (3)...(3): X3 = S or F
  VARIANT (4)...(4): X4 = N or S
  VARIANT (5)...(5): X5 = M or E
  VARIANT (6)...(6): X6 = D or N
  VARIANT (7)...(7): X7 = M or T
XXXXXXX

SEQ ID NO: 246 - protein, 311 aa, Homo sapiens
  TCR 6, TCR 12, TCR 55 - (E7)11 -Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 247 - protein, 8 aa, Artificial Sequence
  TCR Alpha Overall CDR2 Consensus
  VARIANT (1)...(1): X1 = G, Q, I, V, Y, or M
  VARIANT (2)...(2): X2 = L, S, Q, Y, F, or T
  VARIANT (3)...(3): X3 = T, G, S, L, or F
  VARIANT (4)...(4): X4 = Y, S, N, A, or null
  VARIANT (5)...(5): X5 = null, A, or D
  VARIANT (6)...(6): X6 = null, E, Q, S, M, or T
  VARIANT (7)...(7): X7 = S, Q, R, G, D, L, or N
  VARIANT (8)...(8): X8 = N, E, M, T, or V
XXXXXXXX

SEQ ID NO: 248 - protein, 18 aa, Artificial Sequence
  TCR Alpha E6(29-38) CDR3 Consensus
  VARIANT (1)...(1): X1 = A, I, or V
  VARIANT (2)...(2): X2 = M, L, S, or V
  VARIANT (3)...(3): X3 = R, L, Q, or N
  VARIANT (4)...(4): X4 = E, V, T, P, G, or F
  VARIANT (5)...(5): X5 = G, I, L, A, null, or P
  VARIANT (6)...(6): X6 = R, T, G, null, or S
  VARIANT (7)...(7): X7 = G, R, or null
  VARIANT (8)...(8): X8 = T, G, or null
  VARIANT (9)...(9): X9 = null or A
  VARIANT (10)...(10): X10 = null or G
  VARIANT (11)...(11): X11 = null or G
  VARIANT (12)...(12): X12 = null or T
  VARIANT (13)...(13): X13 = null or S
  VARIANT (14)...(14): X14 = G, Y, null, or N
  VARIANT (15)...(15): X15 = F, G, N, or T
  VARIANT (16)...(16): X16 = K or N, P
  VARIANT (17)...(18): X17 = T or L X18 = I, V, F or T
XXXXXXXXXXXXXXXXXX

SEQ ID NO: 249 - protein, 11 aa, Artificial Sequence
  TCR Alpha E7(11-19) CDR3 Consensus
  VARIANT (1)...(1): X1 = A or V
  VARIANT (2)...(3): X2 = E or V
  VARIANT (3)...(3): X3 = S or P
  VARIANT (4)...(4): X4 = I, S, or R
  VARIANT (5)...(5): X5 = R, G, or D
  VARIANT (6)...(6): X6 = G, A, or N
  VARIANT (7)...(7): X7 = F, null, or Y
  VARIANT (8)...(8): X8 = G or T
  VARIANT (9)...(9): X9 = N, T, or Q
  VARIANT (10)...(10): X10 = V, K or N
  VARIANT (11)...(11): X11 = L or F
XXXXXXXXXXX

SEQ ID NO: 250 - protein, 311 aa, Homo sapiens
  TCR 6, TCR 12, TCR 55 - (E7)11  - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 251 - protein, 18 aa, Artificial Sequence
  TCR Alpha Overall CDR3 Consensus
  VARIANT (1)...(1): X1 = A, I, or V
  VARIANT (2)...(2): X2 = M, L, V, E, or S
  VARIANT (3)...(3): X3 = R, L, N, Q, P, or S
  VARIANT (4)...(4): X4 = E, V, P, T, F, I, R, G, S, or A
  VARIANT (5)...(5): X5 = G, I, L, A, P, R, D, null, or H
  VARIANT (6)...(6): X6 = R, T, G, S, N, null, or A
  VARIANT (7)...(7): X7 = G, R, N, or null
  VARIANT (8)...(8): X8 = T, G, or null
  VARIANT (9)...(9): X9 = null, or A
  VARIANT (10)...(10): X10 = null or G
  VARIANT (11)...(11): X11 = null or G
  VARIANT (12)...(12): X12 = null or T
  VARIANT (13)...(13): X13 = F, Y, S or null
  VARIANT (14)...(14): X14 = G, Y, null, or N
  VARIANT (15)...(15): X15 = F, G, T, N, Q, or Y
  VARIANT (16)...(16): X16 = K, P, V, N or A
  VARIANT (17)...(18): X17 = T, L, or F X18 = I, V, T, H, F, or N
XXXXXXXXXXXXXXXXXX

SEQ ID NO: 252 - protein, 5 aa, Artificial Sequence
  TCR Beta E6(29-38) CDR1 Consensus
  VARIANT (1)...(1): X1 = S or M
  VARIANT (2)...(2): X2 = G, E, D, or N
  VARIANT (4)...(4): X4 = V, N, or E
  VARIANT (5)...(5): X5 = S, R, N, or Y
XXHXX

SEQ ID NO: 253 - protein, 270 aa, Homo sapiens
  TCR 13 - Alpha Native
MLLLLVPVLEVIFTLGGTRAQSVTQLDSHVSVSEGTPVLLRCNYSSSYSPSLFWYVQHPNKGLQLLLKYTSAATLVKGINGFEAEFKKSETSFHLTKPSAHMSDAAEYFCVVRGGKLIFGQGTELSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 254 - protein, 5 aa, Artificial Sequence
  TCR beta Overall CDR1 Consensus
  VARIANT (1)...(1): X1 = S or M
  VARIANT (2)...(2): X2 = G, E, D, N, or Q
  VARIANT (3)...(3): X3 = H or V
  VARIANT (4)...(4): X4 = V, N, E, L, or T
  VARIANT (5)...(5): X5 = S, R, N, Y, or M
XXXXX

SEQ ID NO: 255 - protein, 6 aa, Artificial Sequence
  TCR Beta E6(29-38) CDR2 Consensus
  VARIANT (1)...(1): X1 = F or S
  VARIANT (2)...(2): X2 = Q, Y, or V
  VARIANT (3)...(3): X3 = N, D, or G
  VARIANT (4)...(4): X4 = E or V
  VARIANT (5)...(5): X5 = A, K, or G
  VARIANT (6)...(6): X6 = Q, M, or T
XXXXXX

SEQ ID NO: 256 - protein, 270 aa, Homo sapiens
  TCR 13 - Alpha Cysteine-modified
MLLLLVPVLEVIFTLGGTRAQSVTQLDSHVSVSEGTPVLLRCNYSSSYSPSLFWYVQHPNKGLQLLLKYTSAATLVKGINGFEAEFKKSETSFHLTKPSAHMSDAAEYFCVVRGGKLIFGQGTELSVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 257 - protein, 7 aa, Artificial Sequence
  TCR Beta Overall CDR2 Consensus
  VARIANT (1)...(1): X1 = F, S, or A
  VARIANT (2)...(2): X2 = Q, Y, V, or N
  VARIANT (3)...(3): X3 = N, D, G, or Q
  VARIANT (5)...(5): X5 = E, V, N, or S
  VARIANT (6)...(6): X6 = A, K, G, or E
  VARIANT (7)...(7): X7 = Q, M, T, I, or A
XXXGXXX

SEQ ID NO: 258 - protein, 13 aa, Artificial Sequence
  TCR Beta E6(29-38) CDR3 Consensus
  VARIANT (3)...(3): X3 = S or T
  VARIANT (4)...(4): X4 = H, P, L, F, or Y
  VARIANT (5)...(5): X5 = L, G, W, F, T, or S
  VARIANT (6)...(6): X6 = A, G, or L
  VARIANT (7)...(7): X7 = G, E, A, T, Q, or null
  VARIANT (8)...(8): X8 = F, G, T, R, or S
  VARIANT (9)...(9): X9 = T, N, H, R, E, or A
  VARIANT (10)...(10): X10 = G, T, Q, D, R, or Y
  VARIANT (11)...(11): X11 = E, P, T, or G
  VARIANT (12)...(12): X12 = L, A, Q, or Y
  VARIANT (13)...(13): X13 = F, H, Y, or T
ASXXXXXXXXXXX

SEQ ID NO: 259 - protein, 11 aa, Artificial Sequence
  TCR Beta E7(11-19) CDR3 Consensus
  VARIANT (2)...(2): X2 = S or I
  VARIANT (4)...(4): X4 = T or D
  VARIANT (6)...(6): X6 = S or T
  VARIANT (7)...(7): X7 = S or N
  VARIANT (9)...(9): X9 = E or G
  VARIANT (10)...(10): X10 = Q or Y
  VARIANT (11)...(11): X11 = Y or T
AXTXRXXYXXX

SEQ ID NO: 260 - protein, 312 aa, Homo sapiens
  TCR 13 - Beta Native
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSPTGTERELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 261 - protein, 15 aa, Artificial Sequence
  TCR Beta Overall CDR3 Consensus
  VARIANT (1)...(1): X1 = A or S
  VARIANT (2)...(2): X2 = S, I, or V
  VARIANT (3)...(3): X3 = S, T, or V
  VARIANT (4)...(4): X4 = H, P, L, Y, T, D, or F
  VARIANT (5)...(5): X5 = L, G, W, F, S, T, or R
  VARIANT (6)...(6): X6 = A, G, L, S, or T
  VARIANT (7)...(7): X7 = G, E, A, T, R, Q, or null
  VARIANT (8)...(8): X8 = null or G
  VARIANT (9)...(9): X9 = null or G
  VARIANT (10)...(10): X10 = null, F, G, T, S, or R
  VARIANT (11)...(11): X11 = T, N, H, A, S, R, or E
  VARIANT (12)...(12): X12 = G, T, Q, D, Y, or R
  VARIANT (13)...(13): X13 = E, P, T, or G
  VARIANT (14)...(14): X14 = L, A, Q, or Y
  VARIANT (15)...(15): X15 = F, H, Y, or T
XXXXXXXXXXXXXXX

SEQ ID NO: 262 - protein, 137 aa, Mus musculus
  Mouse Alpha Constant
DIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSS

SEQ ID NO: 263 - protein, 173 aa, Mus musculus
  Mouse Beta Constant
EDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 264 - protein, 158 aa, Human papillomavirus
  HPV 16 E6
MHQKRTAMFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSRTRRETQL

SEQ ID NO: 265 - protein, 98 aa, Human papillomavirus
  HPV 16 E7
MHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKP

SEQ ID NO: 266 - protein, 10 aa, Artificial Sequence
  Linker
  REPEAT (5)...(9): Occurring 5 or 6 times
PGGGSGGGGP

SEQ ID NO: 267 - protein, 17 aa, Artificial Sequence
  Linker
GSADDAKKDAAKKDGKS

SEQ ID NO: 268 - protein, 12 aa, Homo sapiens
  Spacer (IgG4hinge)
ESKYGPPCPPCP

SEQ ID NO: 269 - DNA, 36 bp, Homo sapiens
  Spacer (IgG4hinge)
gaatctaagtacggaccgccctgccccccttgccct

SEQ ID NO: 270 - protein, 119 aa, Homo sapiens
  Hinge-CH3 Spacer
ESKYGPPCPPCPGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 271 - protein, 229 aa, Homo sapiens
  Hinge-CH2-CH3 Spacer
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 272 - protein, 282 aa, Homo sapiens
  IgD-hinge-Fc
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 273 - protein, 357 aa, Artificial Sequence
  tEGFR
MLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 274 - protein, 24 aa, Artificial Sequence
  T2A
LEGGGEGRGSLLTCGDVEENPGPR

SEQ ID NO: 275 - protein, 27 aa, Homo sapiens
  CD28 (amino acids 153-179 of Accession No. P10747)
FWVLVVVGGVLACYSLLVTVAFIIFWV

SEQ ID NO: 276 - protein, 66 aa, Homo sapiens
  CD28 (amino acids 114-179 of Accession No. P10747)
IEVMYPPPYLDNEKSNGTIIHVKGKHLCPSPLFPGPSKPFWVLVVVGGVLACYSLLVTVAFIIFWV

SEQ ID NO: 277 - protein, 41 aa, Homo sapiens
  CD28 (amino acids 180-220 of P10747)
RSKRSRLLHSDYMNMTPRRPGPTRKHYQPYAPPRDFAAYRS

SEQ ID NO: 278 - protein, 41 aa, Homo sapiens
  CD28 (LL to GG)
RSKRSRGGHSDYMNMTPRRPGPTRKHYQPYAPPRDFAAYRS

SEQ ID NO: 279 - protein, 42 aa, Homo sapiens
  4-1BB (amino acids 214-255 of Q07011.1)
KRGRKKLLYIFKQPFMRPVQTTQEEDGCSCRFPEEEEGGCEL

SEQ ID NO: 280 - protein, 112 aa, Homo sapiens
  CD3 zeta
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 281 - protein, 112 aa, Homo sapiens
  CD3 zeta
RVKFSRSAEPPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 282 - protein, 112 aa, Homo sapiens
  CD3 zeta
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 283 - protein, 252 aa, Homo sapiens
  TCR 12 / TCR 55 - (E7)11 - Alpha  Native
GEDVEQSLFLSVREGDSSVINCTYTDSSSTYLYWYKQEPGAGLQLLTYIFSNMDMKQDQRLTVLLNKKDKHLSLRIADTQTGDSAIYFCAVPSGATNKLIFGTGTLLAVQPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 284 - protein, 252 aa, Homo sapiens
  TCR 12 / TCR 55- (E7)11 - Alpha Cysteine-modified
GEDVEQSLFLSVREGDSSVINCTYTDSSSTYLYWYKQEPGAGLQLLTYIFSNMDMKQDQRLTVLLNKKDKHLSLRIADTQTGDSAIYFCAVPSGATNKLIFGTGTLLAVQPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 285 - protein, 292 aa, Homo sapiens; identical to SEQ ID NO: 52
  TCR 6, TCR 12, TCR 55 - (E7)11 - Beta Native

SEQ ID NO: 286 - protein, 292 aa, Homo sapiens; identical to SEQ ID NO: 53
  TCR 6, TCR 12, TCR 55  - (E7)11 - Beta Cysteine-modified

SEQ ID NO: 287 - protein, 251 aa, Homo sapiens
  TCR 13 - Alpha Native
AQSVTQLDSHVSVSEGTPVLLRCNYSSSYSPSLFWYVQHPNKGLQLLLKYTSAATLVKGINGFEAEFKKSETSFHLTKPSAHMSDAAEYFCVVRGGKLIFGQGTELSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 288 - protein, 251 aa, Homo sapiens
  TCR 13 - Alpha  Cysteine-modified
AQSVTQLDSHVSVSEGTPVLLRCNYSSSYSPSLFWYVQHPNKGLQLLLKYTSAATLVKGINGFEAEFKKSETSFHLTKPSAHMSDAAEYFCVVRGGKLIFGQGTELSVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 289 - protein, 293 aa, Homo sapiens
  TCR 13 - Beta Native
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSPTGTERELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 290 - protein, 293 aa, Homo sapiens
  TCR 13 -Beta Cysteine-modified
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSPTGTERELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 291 - protein, 252 aa, Homo sapiens
  TCR 14 -Alpha Native
ILNVEQSPQSLHVQEGDSTNFTCSFPSSNFYALHWYRWETAKSPEALFVMTLNGDEKKKGRISATLNTKEGYSYLYIKGSQPEDSATYLCASQTGANNLFFGTGTRLTVIPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 292 - protein, 252 aa, Homo sapiens
  TCR 14 -Alpha  Cysteine-modified
ILNVEQSPQSLHVQEGDSTNFTCSFPSSNFYALHWYRWETAKSPEALFVMTLNGDEKKKGRISATLNTKEGYSYLYIKGSQPEDSATYLCASQTGANNLFFGTGTRLTVIPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 293 - protein, 291 aa, Homo sapiens
  TCR 14 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASTFWGQRRTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 294 - protein, 291 aa, Homo sapiens
  TCR 14 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASTFWGQRRTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 295 - protein, 111 aa, Homo sapiens
  TCR 12/ TCR 55 -  Alpha Variable
GEDVEQSLFLSVREGDSSVINCTYTDSSSTYLYWYKQEPGAGLQLLTYIFSNMDMKQDQRLTVLLNKKDKHLSLRIADTQTGDSAIYFCAVPSGATNKLIFGTGTLLAVQP

SEQ ID NO: 296 - protein, 113 aa, Homo sapiens; identical to SEQ ID NO: 118
  TCR 6, TCR 12, TCR 55  -  Beta Variable

SEQ ID NO: 297 - protein, 110 aa, Homo sapiens
  TCR 13 -  Alpha Variable
AQSVTQLDSHVSVSEGTPVLLRCNYSSSYSPSLFWYVQHPNKGLQLLLKYTSAATLVKGINGFEAEFKKSETSFHLTKPSAHMSDAAEYFCVVRGGKLIFGQGTELSVKP

SEQ ID NO: 298 - protein, 114 aa, Homo sapiens
  TCR 13 -  Beta Variable
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSPTGTERELFFGEGSRLTVL

SEQ ID NO: 299 - protein, 111 aa, Homo sapiens
  TCR 14 -  Alpha Variable
ILNVEQSPQSLHVQEGDSTNFTCSFPSSNFYALHWYRWETAKSPEALFVMTLNGDEKKKGRISATLNTKEGYSYLYIKGSQPEDSATYLCASQTGANNLFFGTGTRLTVIP

SEQ ID NO: 300 - protein, 114 aa, Homo sapiens
  TCR 14 -  Beta Variable
DVKVTQSSRYLVKRTGEKVFLECVQDMDHENMFWYRQDPGLGLRLIYFSYDVKMKEKGDIPEGYSVSREKKERFSLILESASTNQTSMYLCASTFWGQRRTEAFFGQGTRLTVV

SEQ ID NO: 301 - protein, 11 aa, Homo sapiens
  TCR 12/ TCR 55 CDR3 Alpha
AVPSGATNKLI

SEQ ID NO: 302 - protein, 6 aa, Homo sapiens
  TCR 13 CDR1 Alpha
SSYSPS

SEQ ID NO: 303 - protein, 8 aa, Homo sapiens
  TCR 13 CDR2 Alpha
YTSAATLV

SEQ ID NO: 304 - protein, 8 aa, Homo sapiens
  TCR 13 CDR3 Alpha
VVRGGKLI

SEQ ID NO: 305 - protein, 12 aa, Homo sapiens
  TCR 13 CDR3 Beta
ASSPTGTERELF

SEQ ID NO: 306 - protein, 6 aa, Homo sapiens
  TCR 14 CDR1 Alpha
SSNFYA

SEQ ID NO: 307 - protein, 7 aa, Homo sapiens
  TCR 14 CDR2 Alpha
MTLNGDE

SEQ ID NO: 308 - protein, 10 aa, Homo sapiens
  TCR 14 CDR3 Alpha
ASQTGANNLF

SEQ ID NO: 309 - protein, 13 aa, Homo sapiens
  TCR 14 CDR3 Beta
ASTFWGQRRTEAF

SEQ ID NO: 310 - protein, 19 aa, Homo sapiens
  TCR 13 Alpha Signal Sequence
MLLLLVPVLEVIFTLGGTR

SEQ ID NO: 311 - protein, 22 aa, Homo sapiens
  TCR 14 Alpha Signal Sequence
MEKNPLAAPLLILWFHLDCVSS

SEQ ID NO: 312 - protein, 312 aa, Homo sapiens
  TCR 13 - Beta Cysteine-modified
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSPTGTERELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 313 - protein, 274 aa, Homo sapiens
  TCR 14 - Alpha Native
MEKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCASQTGANNLFFGTGTRLTVIPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 314 - protein, 274 aa, Homo sapiens
  TCR 14 - Alpha Cysteine-modified
MEKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCASQTGANNLFFGTGTRLTVIPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 315 - protein, 310 aa, Homo sapiens
  TCR 14 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASTFWGQRRTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 316 - protein, 310 aa, Homo sapiens
  TCR 14 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASTFWGQRRTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 317 - protein, 137 aa, Mus musculus
  Mouse Alpha Constant Sequence
NIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSS

SEQ ID NO: 318 - protein, 275 aa, Homo sapiens
  TCR 3 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGFKTIFGAGTRLFVKANIQKPDPAVYQLRDSKSSDKSVCLFTDFDSQTNVSQSKDSDVYITDKTVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 319 - protein, 275 aa, Homo sapiens
  TCR 3 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGFKTIFGAGTRLFVKANIQKPDPAVYQLRDSKSSDKSVCLFTDFDSQTNVSQSKDSDVYITDKCVLDMRSMDFKSNSAVAWSNKSDFACANAFNNSIIPADTFFPSPESSCDVKLVEKSFETDTNLNFQNLSVIGFRILLLKVAGFNLLMTLRLWSS

SEQ ID NO: 320 - protein, 313 aa, Homo sapiens
  TCR 3 - Beta Native
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSHLAGFTGELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 321 - protein, 313 aa, Homo sapiens
  TCR 3 - Beta Cysteine-modified
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSHLAGFTGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 322 - protein, 271 aa, Homo sapiens
  TCR 4 - (E6)29 Alpha Native
MKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILLVIRGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 323 - protein, 271 aa, Homo sapiens
  TCR 4 - (E6)29 Alpha Cysteine-modified
MKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILLVIRGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 324 - protein, 310 aa, Homo sapiens
  TCR 4 - (E6)29 Beta Native
MGTSLLCWMALCLLGADHADTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSPGGGNTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 325 - protein, 310 aa, Homo sapiens
  TCR 4 - (E6)29 Beta Cysteine-modified
MGTSLLCWMALCLLGADHADTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSPGGGNTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 326 - protein, 278 aa, Homo sapiens
  TCR 5 - (E6)29 - TCR Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGTGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 327 - protein, 278 aa, Homo sapiens
  TCR 5 - (E6)29 - TCR Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGTGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 328 - protein, 310 aa, Homo sapiens
  TCR 5 - (E6)29 - TCR Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGETHQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 329 - protein, 310 aa, Homo sapiens
  TCR 5 - (E6)29 - TCR Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGETHQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 330 - protein, 274 aa, Homo sapiens
  TCR 6 - Alpha Native
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESIRGFGNVLHCGSGTQVIVLPHIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 331 - protein, 274 aa, Homo sapiens
  TCR 6 - Alpha Cysteine-modified
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESIRGFGNVLHCGSGTQVIVLPHIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 332 - protein, 311 aa, Homo sapiens; identical to SEQ ID NO: 246
  TCR 6, TCR 12 - Beta Native

SEQ ID NO: 333 - protein, 311 aa, Homo sapiens; identical to SEQ ID NO: 250
  TCR 6, TCR 12 - Beta Cysteine-modified

SEQ ID NO: 334 - protein, 275 aa, Homo sapiens
  TCR 7/ TCR 54 - (E7)11 - Alpha Native
MKKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSRDNYGQNFVFGPGTRLSVLPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 335 - protein, 275 aa, Homo sapiens
  TCR 7/ TCR 54 - (E7)11 - Alpha Cysteine-modified
MKKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSRDNYGQNFVFGPGTRLSVLPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 336 - protein, 309 aa, Homo sapiens
  TCR 7/ TCR 54 -(E7)11 -Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITDRTNYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 337 - protein, 309 aa, Homo sapiens
  TCR 7/ TCR 54 - (E7)11 -Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITDRTNYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 338 - protein, 272 aa, Homo sapiens
  TCR 8 - Alpha Native
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPLGNTPLVFGKGTRLSVIANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 339 - protein, 272 aa, Homo sapiens
  TCR 8 - Alpha Cysteine-modified
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPLGNTPLVFGKGTRLSVIANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 340 - protein, 606 aa, Homo sapiens
  TCR 12/ TCR 55 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTTRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAVPSGATNKLIFGTGTLLAVQPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 341 - protein, 604 aa, Homo sapiens
  TCR 13 Full sequence Native
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSPTGTERELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMLLLLVPVLEVIFTLGGTRAQSVTQLDSHVSVSEGTPVLLRCNYSSSYSPSLFWYVQHPNKGLQLLLKYTSAATLVKGINGFEAEFKKSETSFHLTKPSAHMSDAAEYFCVVRGGKLIFGQGTELSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 342 - protein, 606 aa, Homo sapiens
  TCR 14 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASTFWGQRRTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMEKNPLAAPLLILWFHLDCVSSILNVEQSPQSLHVQEGDSTNFTCSFPSSNFYALHWYRWETAKSPEALFVMTLNGDEKKKGRISATLNTKEGYSYLYIKGSQPEDSATYLCASQTGANNLFFGTGTRLTVIPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 343 - protein, 335 aa, Artificial Sequence
  tEGFR
RKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 344 - protein, 22 aa, Artificial Sequence
  F2A
VKQTLNFDLLKLAGDVESNPGP

SEQ ID NO: 345 - protein, 19 aa, Artificial Sequence
  P2A
ATNFSLLKQAGDVEENPGP

SEQ ID NO: 346 - protein, 20 aa, Artificial Sequence
  E2A
QCTNYALLKLAGDVESNPGP

SEQ ID NO: 347 - DNA, 66 bp, Artificial Sequence
  TCR 49/ TCR 51/ TCR 52 / TCR 53 / TCR 55 - P2A
ggaagcggcgccacaaacttctcactgctgaaacaggccggcgacgtggaggagaatcctggccca

SEQ ID NO: 348 - DNA, 4627 bp, Homo sapiens
  Human TCR alpha constant (TRAC)
  ref <308>: DATABASE ACCESSION NUMBER: NCBI NG_001332.3
  ref <309>: DATABASE ENTRY DATE: 2016-08-31
atatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggagaagagcagcaggcatgagttgaatgaaggaggcagggccgggtcacagggccttctaggccatgagagggtagacagtattctaaggacgccagaaagctgttgatcggcttcaagcaggggagggacacctaatttgcttttcttttttttttttttttttttttttttttttgagatggagttttgctcttgttgcccaggctggagtgcaatggtgcatcttggctcactgcaacctccgcctcccaggttcaagtgattctcctgcctcagcctcccgagtagctgagattacaggcacccgccaccatgcctggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccatctctgactttccattctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggtagcggaactcactaaggggcccatctggacccgaggtattgtgatgataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctgaggtgaggggccttgaagctgggagtggggtttagggacgcgggtctctgggtgcatcctaagctctgagagcaaacctccctgcagggtcttgcttttaagtccaaagcctgagcccaccaaactctcctacttcttcctgttacaaattcctcttgtgcaataataatggcctgaaacgctgtaaaatatcctcatttcagccgcctcagttgcacttctcccctatgaggtaggaagaacagttgtttagaaacgaagaaactgaggccccacagctaatgagtggaggaagagagacacttgtgtacaccacatgccttgtgttgtacttctctcaccgtgtaacctcctcatgtcctctctccccagtacggctctcttagctcagtagaaagaagacattacactcatattacaccccaatcctggctagagtctccgcaccctcctcccccagggtccccagtcgtcttgctgacaactgcatcctgttccatcaccatcaaaaaaaaactccaggctgggtgcgggggctcacacctgtaatcccagcactttgggaggcagaggcaggaggagcacaggagctggagaccagcctgggcaacacagggagaccccgcctctacaaaaagtgaaaaaattaaccaggtgtggtgctgcacacctgtagtcccagctacttaagaggctgagatgggaggatcgcttgagccctggaatgttgaggctacaatgagctgtgattgcgtcactgcactccagcctggaagacaaagcaagatcctgtctcaaataataaaaaaaataagaactccagggtacatttgctcctagaactctaccacatagccccaaacagagccatcaccatcacatccctaacagtcctgggtcttcctcagtgtccagcctgacttctgttcttcctcattccagatctgcaagattgtaagacagcctgtgctccctcgctccttcctctgcattgcccctcttctccctctccaaacagagggaactctcctacccccaaggaggtgaaagctgctaccacctctgtgcccccccggcaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcctgcagaatgttgtgaggggtttatttttttttaatagtgttcataaagaaatacatagtattcttcttctcaagacgtggggggaaattatctcattatcgaggccctgctatgctgtgtatctgggcgtgttgtatgtcctgctgccgatgccttc

SEQ ID NO: 349 - DNA, 1448 bp, Homo sapiens
  Human TCR beta constant 1 (TRBC1)
  ref <308>: DATABASE ACCESSION NUMBER: NCBI NG_001333.2
  ref <309>: DATABASE ENTRY DATE: 2016-08-31
aggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctga

SEQ ID NO: 350 - protein, 610 aa, Homo sapiens
  TCR 15 Full sequence Cysteine-modified
MDSWTFCCVSLCILVAKHTDAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLVGRSRTEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMKPGGYNKLIFGAGTRLAVHPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 351 - protein, 604 aa, Homo sapiens
  TCR 16 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMETLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPANNNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 352 - protein, 607 aa, Homo sapiens
  TCR 17 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMREGRGDKIIFGKGTRLHILPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 353 - protein, 607 aa, Homo sapiens
  TCR 18 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSFWGRSNSPLHFGNGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMETLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAEGNAGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 354 - protein, 611 aa, Homo sapiens
  TCR 19 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSSWGQSTGEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRENTGTASKLTFGTGTRLQVTLDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 355 - protein, 608 aa, Homo sapiens
  TCR 20 Full sequence Cysteine-modified
MLLLLLLLGPGSGLGAVVSQHPSRVICKSGTSVKIECRSLDFQATTMFWYRQFPKQSLMLMATSNEGSKATYEQGVEKDKFLINHASLTLSTLTVTSAHPEDSSFYICSASSLARRSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMNMLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALWTGANNLFFGTGTRLTVIPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 356 - protein, 625 aa, Homo sapiens
  TCR 21 Full sequence Cysteine-modified
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASRPWGNQNTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRVTGGGNKLTFGTGTQLKVELNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 357 - protein, 617 aa, Homo sapiens
  TCR 22 Full sequence Cysteine-modified
MGPGLLCWVLLCLLGAGPVDAGVTQSPTHLIKTRGQHVTLRCSPISGHKSVSWYQQVLGQGPQFIFQYYEKEERGRGNFPDRFSARQFPNYSSELNVNALLLGDSALYLCASSRTENYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVRARMDSNYQLIWGAGTKLIIKPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 358 - protein, 609 aa, Homo sapiens
  TCR 23 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGQSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMSPPGGSARQLTFGSGTQLTVLPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 359 - protein, 612 aa, Homo sapiens
  TCR 24 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPFGRGSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGDSWGKLQFGAGTQVVVTPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 360 - protein, 611 aa, Homo sapiens
  TCR 25 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGQSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGSLTGGGNKLTFGTGTQLKVELNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 361 - protein, 610 aa, Homo sapiens
  TCR 26 Full sequence Cysteine-modified
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYYASGRNYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRDARNNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 362 - protein, 618 aa, Homo sapiens
  TCR 27 Full sequence Cysteine-modified
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEFGSLNEKLFFGSGTQLSVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILRVPPQSGGYQKVTFGTGTKLQVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 363 - protein, 608 aa, Homo sapiens
  TCR 28 Full sequence Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSSGNTIYFGEGSWLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVRGGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 364 - protein, 611 aa, Homo sapiens
  TCR 29 Full sequence Cysteine-modified
MSNQVLCCVVLCLLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSPWGRATNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRLNTGTASKLTFGTGTRLQVTLDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 365 - protein, 605 aa, Homo sapiens
  TCR 30 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASSRQPSSGNTIYFGEGSWLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMRLVARVTVFLTFGTIIDAKTTQPPSMDCAEGRAANLPCNHSTISGNEYVYWYRQIHSQGPQYIIHGLKNNETNEMASLIITEDRKSSTLILPHATLRDTAVYYCIVRGTSVLQGNEKLTFGTGTRLTIIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 366 - protein, 614 aa, Homo sapiens
  TCR 31 Full sequence Cysteine-modified
MGTRLLFWVAFCLLGADHTGAGVSQSPSNKVTEKGKDVELRCDPISGHTALYWYRQSLGQGLEFLIYFQGNSAPDKSGLPSDRFSAERTGGSVSTLTIQRTQQEDSAVYLCASSRFLGSTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAASERGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 367 - protein, 602 aa, Homo sapiens
  TCR 32 Full sequence Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGGDHSDEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGGSNYKLTFGKGTLLTVNPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 368 - protein, 609 aa, Homo sapiens
  TCR 33 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDTYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNAHHTGGFKTIFGAGTRLFVKANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 369 - protein, 601 aa, Homo sapiens
  TCR 34 Full sequence Cysteine-modified
MGPGLLCWALLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSSYAGSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAVSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 370 - protein, 605 aa, Homo sapiens
  TCR 35 Full sequence Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASTTSGDSSYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMALQSTLGAVWLGLLLNSLWKVAESKDQVFQPSTVASSEGAVVEIFCNHSVSNAYNFFWYLHFPGCAPRLLVKGSKPSQQGRYNMTYERFSSSLLILQVREADAAVYYCAVAGDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 371 - protein, 607 aa, Homo sapiens
  TCR 36 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRSNYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 372 - protein, 603 aa, Homo sapiens
  TCR 37 Full sequence Cysteine-modified
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSLLLGAYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAGYSGAGSYQLTFGKGTKLSVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 373 - protein, 612 aa, Homo sapiens
  TCR 38 Full sequence Cysteine-modified
MGPGLLCWVLLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSLVAGGETQYFGPGTRLLVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMVKMPGARRQSIMKRILGALLGLLSAQVCCVRGIQVEQSPPDLILQEGANSTLRCNFSDSVNNLQWFHQNPWGQLINLFYIPSGTKQNGRLSATTVATERYSLLYISSSQTTDSGVYFCAVGFNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 374 - protein, 592 aa, Homo sapiens
  TCR 39 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDRGKEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMQLTWVSGQQLNQSPQSMFIQEGEDVSMNCTSSSIFNTWLWYKQEPGEGPVLLIALYKAGELTSNGRLTAQFGITRKDSFLNISASIPSDVGIYFCAGYSSSNDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 375 - protein, 638 aa, Homo sapiens
  TCR 40 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITARSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGRNNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 376 - protein, 610 aa, Homo sapiens
  TCR 41 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASNPRDRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVTFALTGGFKTIFGAGTRLFVKANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 377 - protein, 638 aa, Homo sapiens
  TCR 42 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAKTSRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGPDNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 378 - protein, 609 aa, Homo sapiens
  TCR 43 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNVPTSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 379 - protein, 616 aa, Homo sapiens
  TCR 44 Full sequence Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSGTPDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAQYSGGYQKVTFGTGTKLQVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 380 - protein, 642 aa, Homo sapiens
  TCR 45 Full sequence Cysteine-modified
MGTRLLFWVAFCLLGAYHTGAGVSQSPSNKVTEKGKDVELRCDPISGHTALYWYRQRLGQGLEFLIYFQGNSAPDKSGLPSDRFSAERTGESVSTLTIQRTQQEDSAVYLCASSLYLGTTGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGSSGAGSYQLTFGKGTKLSVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 381 - protein, 609 aa, Homo sapiens
  TCR 46 Full sequence Cysteine-modified
MGTRLLCWAALCLLGADHTGAGVSQTPSNKVTEKGKYVELRCDPISGHTALYWYRQSLGQGPEFLIYFQGTGAADDSGLPNDRFFAVRPEGSVSTLKIQRTERGDSAVYLCASSLYLGGSETQYFGPGTRLLVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMLLLLVPAFQVIFTLGGTRAQSVTQLDSQVPVFEEAPVELRCNYSSSVSVYLFWYVQYPNQGLQLLLKYLSGSTLVKGINGFEAEFNKSQTSFHLRKPSVHISDTAEYFCAVSPSSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 382 - protein, 609 aa, Homo sapiens
  TCR 47 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRTTYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNLLSGSARQLTFGSGTQLTVLPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 383 - protein, 607 aa, Homo sapiens
  TCR 48 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTGRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMRIQGAQKLVFGQGTRLTINPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 384 - protein, 609 aa, Homo sapiens
  TCR 49 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRYSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNIGTSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 385 - protein, 604 aa, Homo sapiens
  TCR 50 Full sequence Cysteine-modified
MGFRLLCCVAFCLLGAGPVDSGVTQTPKHLITATGQRVTLRCSPRSGDLSVYWYQQSLDQGLQFLIHYYNGEERAKGNILERFSAQQFPDLHSELNLSSLELGDSALYFCASSATRDAYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESPPGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 386 - protein, 610 aa, Homo sapiens
  TCR 51 Full sequence Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAIASRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMSIYSNGDKEDGRFTAQLNKASQYVSLLIRDSQPSDSATYLCAVNMRGGGSNYKLTFGKGTLLTVNPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 387 - protein, 601 aa, Homo sapiens
  TCR 52 Full sequence Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGDLNNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGARDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 388 - protein, 611 aa, Homo sapiens
  TCR 53 Full sequence Cysteine-modified
MGTSLLCWVVLGFLGTDHTGAGVSQSPRYKVTKRGQDVALRCDPISGHVSLYWYRQALGQGPEFLTYFNYEAQQDKSGLPNDRFSAERPEGSISTLTIQRTEQRDSAMYRCASSGSGTSGYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDFGSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 389 - DNA, 495 bp, Homo sapiens
  TCR 15 - Alpha Native
gaattcttctctcaccatgccaggttcacctcacagtacagagtcctgaaaataaagaagaagatttttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctattctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgaagcctggtggctacaataagctgatttttggagcagggaccaggctggctgtacaccca

SEQ ID NO: 390 - DNA, 455 bp, Homo sapiens
  TCR 15 - Beta Native
gatgctcacagagggcctggtctagaatattccacatctgctctcactctgccatggactcctggaccttctgctgtgtgtccctttgcatcctggtagcgaagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttggtcggcaggagtcggaccgagcagtacttcgggccgggcaccaggctcacggtcaca

SEQ ID NO: 391 - protein, 610 aa, Homo sapiens
  TCR 15 Full sequence Native
MDSWTFCCVSLCILVAKHTDAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLVGRSRTEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMKPGGYNKLIFGAGTRLAVHPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 392 - protein, 604 aa, Homo sapiens
  TCR 16 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMETLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPANNNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 393 - protein, 607 aa, Homo sapiens
  TCR 17 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMREGRGDKIIFGKGTRLHILPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 394 - protein, 607 aa, Homo sapiens
  TCR 18 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSFWGRSNSPLHFGNGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMETLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAEGNAGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 395 - protein, 611 aa, Homo sapiens
  TCR 19 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSSWGQSTGEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRENTGTASKLTFGTGTRLQVTLDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 396 - protein, 608 aa, Homo sapiens
  TCR 20 Full sequence Native
MLLLLLLLGPGSGLGAVVSQHPSRVICKSGTSVKIECRSLDFQATTMFWYRQFPKQSLMLMATSNEGSKATYEQGVEKDKFLINHASLTLSTLTVTSAHPEDSSFYICSASSLARRSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMNMLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALWTGANNLFFGTGTRLTVIPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 397 - protein, 625 aa, Homo sapiens
  TCR 21 Full sequence Native
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASRPWGNQNTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRVTGGGNKLTFGTGTQLKVELNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 398 - protein, 617 aa, Homo sapiens
  TCR 22 Full sequence Native
MGPGLLCWVLLCLLGAGPVDAGVTQSPTHLIKTRGQHVTLRCSPISGHKSVSWYQQVLGQGPQFIFQYYEKEERGRGNFPDRFSARQFPNYSSELNVNALLLGDSALYLCASSRTENYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVRARMDSNYQLIWGAGTKLIIKPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 399 - protein, 609 aa, Homo sapiens
  TCR 23 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGQSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMSPPGGSARQLTFGSGTQLTVLPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 400 - protein, 612 aa, Homo sapiens
  TCR 24 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPFGRGSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGDSWGKLQFGAGTQVVVTPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 401 - protein, 611 aa, Homo sapiens
  TCR 25 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGQSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGSLTGGGNKLTFGTGTQLKVELNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 402 - protein, 610 aa, Homo sapiens
  TCR 26 Full sequence Native
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYYASGRNYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRDARNNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 403 - protein, 618 aa, Homo sapiens
  TCR 27 Full sequence Native
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEFGSLNEKLFFGSGTQLSVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILRVPPQSGGYQKVTFGTGTKLQVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 404 - protein, 608 aa, Homo sapiens
  TCR 28 Full sequence Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSSGNTIYFGEGSWLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVRGGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 405 - protein, 611 aa, Homo sapiens
  TCR 29 Full sequence Native
MSNQVLCCVVLCLLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSPWGRATNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRLNTGTASKLTFGTGTRLQVTLDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 406 - protein, 605 aa, Homo sapiens
  TCR 30 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASSRQPSSGNTIYFGEGSWLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMRLVARVTVFLTFGTIIDAKTTQPPSMDCAEGRAANLPCNHSTISGNEYVYWYRQIHSQGPQYIIHGLKNNETNEMASLIITEDRKSSTLILPHATLRDTAVYYCIVRGTSVLQGNEKLTFGTGTRLTIIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 407 - protein, 614 aa, Homo sapiens
  TCR 31 Full sequence Native
MGTRLLFWVAFCLLGADHTGAGVSQSPSNKVTEKGKDVELRCDPISGHTALYWYRQSLGQGLEFLIYFQGNSAPDKSGLPSDRFSAERTGGSVSTLTIQRTQQEDSAVYLCASSRFLGSTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAASERGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 408 - protein, 602 aa, Homo sapiens
  TCR 32 Full sequence Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGGDHSDEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGGSNYKLTFGKGTLLTVNPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 409 - protein, 609 aa, Homo sapiens
  TCR 33 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDTYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNAHHTGGFKTIFGAGTRLFVKANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 410 - protein, 601 aa, Homo sapiens
  TCR 34 Full sequence Native
MGPGLLCWALLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSSYAGSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAVSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 411 - protein, 605 aa, Homo sapiens
  TCR 35 Full sequence Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASTTSGDSSYNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMALQSTLGAVWLGLLLNSLWKVAESKDQVFQPSTVASSEGAVVEIFCNHSVSNAYNFFWYLHFPGCAPRLLVKGSKPSQQGRYNMTYERFSSSLLILQVREADAAVYYCAVAGDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 412 - protein, 607 aa, Homo sapiens
  TCR 36 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRSNYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 413 - protein, 603 aa, Homo sapiens
  TCR 37 Full sequence Native
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSLLLGAYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAGYSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 414 - protein, 612 aa, Homo sapiens
  TCR 38 Full sequence Native
MGPGLLCWVLLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSLVAGGETQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMVKMPGARRQSIMKRILGALLGLLSAQVCCVRGIQVEQSPPDLILQEGANSTLRCNFSDSVNNLQWFHQNPWGQLINLFYIPSGTKQNGRLSATTVATERYSLLYISSSQTTDSGVYFCAVGFNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 415 - protein, 592 aa, Homo sapiens
  TCR 39 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDRGKEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMQLTWVSGQQLNQSPQSMFIQEGEDVSMNCTSSSIFNTWLWYKQEPGEGPVLLIALYKAGELTSNGRLTAQFGITRKDSFLNISASIPSDVGIYFCAGYSSSNDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 416 - protein, 638 aa, Homo sapiens
  TCR 40 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITARSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGRNNFNKFYFGSGTKLNVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 417 - protein, 610 aa, Homo sapiens
  TCR 41 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASNPRDRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVTFALTGGFKTIFGAGTRLFVKANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 418 - protein, 638 aa, Homo sapiens
  TCR 42 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAKTSRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGPDNFNKFYFGSGTKLNVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 419 - protein, 609 aa, Homo sapiens
  TCR 43 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNVPTSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 420 - protein, 616 aa, Homo sapiens
  TCR 44 Full sequence Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSGTPDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAQYSGGYQKVTFGTGTKLQVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 421 - protein, 642 aa, Homo sapiens
  TCR 45 Full sequence Native
MGTRLLFWVAFCLLGAYHTGAGVSQSPSNKVTEKGKDVELRCDPISGHTALYWYRQRLGQGLEFLIYFQGNSAPDKSGLPSDRFSAERTGESVSTLTIQRTQQEDSAVYLCASSLYLGTTGELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGSSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 422 - protein, 609 aa, Homo sapiens
  TCR 46 Full sequence Native
MGTRLLCWAALCLLGADHTGAGVSQTPSNKVTEKGKYVELRCDPISGHTALYWYRQSLGQGPEFLIYFQGTGAADDSGLPNDRFFAVRPEGSVSTLKIQRTERGDSAVYLCASSLYLGGSETQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMLLLLVPAFQVIFTLGGTRAQSVTQLDSQVPVFEEAPVELRCNYSSSVSVYLFWYVQYPNQGLQLLLKYLSGSTLVKGINGFEAEFNKSQTSFHLRKPSVHISDTAEYFCAVSPSSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 423 - protein, 609 aa, Homo sapiens
  TCR 47 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRTTYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNLLSGSARQLTFGSGTQLTVLPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 424 - protein, 607 aa, Homo sapiens
  TCR 48 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTGRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMRIQGAQKLVFGQGTRLTINPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 425 - protein, 609 aa, Homo sapiens
  TCR 49 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRYSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNIGTSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 426 - protein, 604 aa, Homo sapiens
  TCR 50 Full sequence Native
MGFRLLCCVAFCLLGAGPVDSGVTQTPKHLITATGQRVTLRCSPRSGDLSVYWYQQSLDQGLQFLIHYYNGEERAKGNILERFSAQQFPDLHSELNLSSLELGDSALYFCASSATRDAYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESPPGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 427 - protein, 610 aa, Homo sapiens
  TCR 51 Full sequence Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAIASRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMMKSLRVLLVILWLQLSWVWSQQKEVEQNSGPLSVPEGAIASLNCTYSDRGSQSFFWYRQYSGKSPELIMSIYSNGDKEDGRFTAQLNKASQYVSLLIRDSQPSDSATYLCAVNMRGGGSNYKLTFGKGTLLTVNPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 428 - protein, 601 aa, Homo sapiens
  TCR 52 Full sequence Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGDLNNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGARDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 429 - protein, 611 aa, Homo sapiens
  TCR 53 Full sequence Native
MGTSLLCWVVLGFLGTDHTGAGVSQSPRYKVTKRGQDVALRCDPISGHVSLYWYRQALGQGPEFLTYFNYEAQQDKSGLPNDRFSAERPEGSISTLTIQRTEQRDSAMYRCASSGSGTSGYNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDFGSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 430 - DNA, 472 bp, Homo sapiens
  TCR 16 - Alpha Native
agagtgtttatcttgtgagccattctccatatttcagatataagatttcagttctcagtgagtctaagtgacagaaggaatggagaccctcttgggcctgcttatcctttggctgcagctgcaatgggtgagcagcaaacaggaggtgacgcagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgtgaggcccgccaataacaatgacatgcgctttggagcagggaccagactgacagtaaaacca

SEQ ID NO: 431 - DNA, 420 bp, Homo sapiens
  TCR 16 - Beta Native
gattctttcttcaaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgggggcgcagcaatcagccccagcattttggtgatgggactcgactctccatccta

SEQ ID NO: 432 - DNA, 1833 bp, Homo sapiens
  TCR 15 Codon-optimized / cysteine-modified full sequence
atggacagctggaccttttgctgcgtgtccctgtgcatcctggtggccaagcacaccgatgccggcgtgatccagagccccagacacgaagtgaccgagatgggccaggaagtgaccctgcgctgcaagcccatcagcggccacaacagcctgttctggtacagacagaccatgatgcggggcctggaactgctgatctacttcaacaacaacgtgcccatcgacgacagcggcatgcccgaggacagattcagcgccaagatgcccaacgccagcttcagcaccctgaagatccagcccagcgagcccagagacagcgccgtgtacttttgcgccagcagcctcgtgggcagaagccggaccgagcagtactttggccctggcaccagactgaccgtgaccgaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgaagcctggcggctacaacaagctgatcttcggagccggcaccagactggccgtgcacccttatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 433 - DNA, 1815 bp, Homo sapiens
  TCR 16 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcctgtggggcagaagcaaccagcctcagcacttcggcgacggcaccagactgagcatcctcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatggaaaccctgctgggcctgctgatcctgtggctgcagctccagtgggtgtccagcaagcaggaagtgacccagatccctgccgccctgtctgtgcctgagggcgagaacctggtgctgaactgcagcttcaccgacagcgccatctacaacctgcagtggttccggcaggaccccggcaagggactgacaagcctgctgctgattcagagcagccagagagagcagaccagcggcagactgaacgccagcctggacaagtcctccggcagaagcaccctgtatatcgccgcctcccagcctggcgatagcgccacatatctgtgtgccgtgcggcctgccaacaacaacgacatgagattcggagccggcacccggctgaccgtgaagcctaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 434 - DNA, 1824 bp, Homo sapiens
  TCR 17 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcctgtggggcagaagcaaccagcctcagcacttcggcgacggcaccagactgagcatcctcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccccagctacggcctgttctggtacaagcagcccagcagcggcgagatgatcttcctgatctaccagggcagctacgaccagcagaacgccaccgagggccggtacagcctgaacttccagaaggcccggaagtccgccaacctggtcatctctgccagccagctgggcgacagcgccatgtacttttgcgccatgagagagggcagaggcgacaagatcattttcggcaagggcacccggctgcacatcctgcccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 435 - DNA, 1824 bp, Homo sapiens
  TCR 18 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcttctggggcagaagcaacagccctctgcacttcggcaacggcaccagactgaccgtgaccgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatggaaaccctgctgggcctgctgatcctgtggctgcagctccagtgggtgtccagcaagcaggaagtgacccagatccctgccgccctgtctgtgcctgagggcgagaacctggtgctgaactgcagcttcaccgacagcgccatctacaacctgcagtggttccggcaggaccccggcaagggactgacaagcctgctgctgattcagagcagccagagagagcagaccagcggcagactgaacgccagcctggacaagtcctccggcagaagcaccctgtatatcgccgcctcccagcctggcgatagcgccacatatctgtgcgccgagggcaatgccggcggaaccagctacggcaagctgacctttggccagggcaccatcctgaccgtgcaccccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 436 - DNA, 1836 bp, Homo sapiens
  TCR 19 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcagctggggccagagcacaggcgagcagtactttggccctggcaccagactgaccgtgaccgaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagagagaacaccggcaccgccagcaagctgaccttcggcacaggcaccagactgcaggtcacactggacatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 437 - DNA, 1827 bp, Homo sapiens
  TCR 20 Codon-optimized / cysteine-modified full sequence
atgctgctgctcctgctcctcctgggacctggatctggactgggagccgtggtgtcccagcaccccagcagagtgatctgcaagagcggcaccagcgtgaagatcgagtgcagaagcctggacttccaggccaccaccatgttctggtacagacagttccccaagcagagcctgatgctgatggccacctccaacgagggcagcaaggccacatacgagcagggcgtggaaaaggacaagttcctgatcaaccacgccagcctgaccctgagcaccctgacagtgacaagcgcccaccccgaggacagcagcttctacatctgtagcgccagcagcctggccagaagaagctacgagcagtacttcggccctggcaccagactgaccgtgaccgaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgaacatgctgaccgccagcctgctgagagccgtgatcgccagcatctgcgtggtgtccagcatggcccagaaagtgacccaggcccagaccgagatcagcgtggtggaaaaagaagatgtgaccctggactgcgtgtacgagacacgggacaccacctactacctgttctggtacaagcagcctcccagcggcgagctggtgttcctgatcagacggaacagcttcgacgagcagaacgagattagcggccggtacagctggaacttccagaagtccaccagcagcttcaacttcaccatcaccgcctcccaggtggtggacagcgccgtgtacttttgtgccctgtggaccggggccaacaacctgttctttggcaccggaacccggctgaccgtgatcccctatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 438 - DNA, 1878 bp, Homo sapiens
  TCR 21 Codon-optimized / cysteine-modified full sequence
atgcacagacctagaaggcccctgcatcccgtggcccctgccatgtctatcggcctgctgtgctgcgtggcattctccctgctgtgggcctctcctgtgaatgccggcgtgacccagacccctaagttccaggtgctgaaaaccggccagagcatgaccctgcagtgcgcccaggacatgaaccacaacagcatgtactggtacagacaggaccccggcatgggcctgcggctgatctactatagcgccagcgagggcaccaccgacaagggcgaggtgcccaacggctacaacgtgtcccggctgaacaagagagagttcagcctgagactggaaagcgccgctcccagccagaccagcgtgtacttctgtgccagcagaccctggggcaaccagaacaccgaggcattctttgggcagggcacccggctgacagtggtcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgcgcgagggcagagtgaccggcggaggcaacaagctgacctttggcaccggcacccagctgaaagtggaactgaacatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 439 - DNA, 1854 bp, Homo sapiens
  TCR 22 Codon-optimized / cysteine-modified full sequence
atgggacctggactgctgtgctgggtgctgctgtgtctgctgggagccggacctgtggatgccggcgtgacacagagccccacccacctgatcaagaccagaggccagcacgtgaccctgcggtgtagccctatcagcggccacaagagcgtgtcctggtatcagcaggtcctgggccagggccctcagttcatcttccagtactacgagaaagaggaacgcggcagaggcaacttccccgacagattcagcgccagacagttccccaactacagcagcgagctgaacgtgaacgccctgctgctgggcgatagcgccctgtacctgtgtgccagcagccggaccgagaactacggctacaccttcggcagcggcaccagactgacagtggtcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatggcccaggaactgggcatgcagtgtcaggccagaggcatcctgcagcagatgtggggcgtgttcctgctgtacgtgtccatgaagatgggcggcaccaccggccagaacatcgaccagcctaccgagatgaccgccaccgagggcgctatcgtgcagatcaactgcacctaccagaccagcggcttcaacggcctgttctggtatcagcagcacgccggcgaggcccctaccttcctgagctacaatgtgctggacggcctggaagagaagggccggttcagcagcttcctgtccagaagcaagggctacagctacctgctgctgaaagaactgcagatgaaggacagcgcctcctacctgtgtgccgtgcgggccagaatggacagcaactaccagctgatctggggagccggcaccaagctgatcatcaagcccgacatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 440 - DNA, 1830 bp, Homo sapiens
  TCR 23 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcccctggggccagtctaatcagcctcagcacttcggcgacggcacccggctgtctattctcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagcccacctggcggcagcgccagacagctgacatttggctctggcacccagctgaccgtgctgcccgatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 441 - DNA, 1839 bp, Homo sapiens
  TCR 24 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagccctttcggcagaggcagctacgagcagtacttcggccctggcaccagactgaccgtgaccgaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagagagggcagaggcgacagctggggcaagctgcagtttggagccggcacccaggtggtcgtgacccctgatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 442 - DNA, 1836 bp, Homo sapiens
  TCR 25 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcctgtggggccagagcaatcagcctcagcacttcggcgacggcacccggctgtctattctcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagagagggcagcctgaccggcggaggcaacaagctgacctttggcaccggcacccagctgaaagtggaactgaacatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 443 - DNA, 1833 bp, Homo sapiens
  TCR 26 Codon-optimized / cysteine-modified full sequence
atgtctctgggactgctgtgctgcggagccttctctctgctgtgggccggacctgtgaatgccggcgtgacccagacccctaagttccgggtgctgaaaaccggccagagcatgaccctgctgtgcgcccaggacatgaaccacgagtacatgtattggtacagacaggaccccggcatgggcctgcggctgatccactattctgtgggcgagggcaccaccgccaagggcgaagtgcctgacggctacaacgtgtcccggctgaagaagcagaacttcctgctgggcctggaaagcgccgctcctagccagaccagcgtgtacttctgcgccagcagctactacgccagcggccggaactacgagcagtacttcggccctggcacccggctgacagtgacagaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgcgggacgcccggaacaacgacatgagattcggagccggcacccggctgaccgtgaagcctaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 444 - DNA, 1857 bp, Homo sapiens
  TCR 27 Codon-optimized / cysteine-modified full sequence
atgcacagacctagaaggcccctgcatcccgtggcccctgccatgtctatcggcctgctgtgctgcgtggcattctccctgctgtgggcctctcctgtgaatgccggcgtgacccagacccctaagttccaggtgctgaaaaccggccagagcatgaccctgcagtgcgcccaggacatgaaccacaacagcatgtactggtacagacaggaccccggcatgggcctgcggctgatctactatagcgccagcgagggcaccaccgacaagggcgaggtgcccaacggctacaacgtgtcccggctgaacaagagagagttcagcctgagactggaaagcgccgctcccagccagaccagcgtgtacttttgcgccagcagcgagttcggcagcctgaacgagaagctgttcttcggcagcggcacccagctgagcgtgctcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatgaagctggtcaccagcatcaccgtgctgctgagcctgggaatcatgggcgacgccaagaccacccagcccaacagcatggaaagcaacgaagaggaacccgtgcatctgccctgcaaccacagcaccatcagcggcaccgactacatccactggtacagacagctgcccagccagggccccgagtatgtgatccacggcctgaccagcaacgtgaacaaccggatggcctccctggccattgccgaggacagaaagagcagcaccctgatcctgcaccgggccacactgagagatgccgccgtgtactactgcatcctgcgggtgccacctcagagcggcggctaccagaaagtgaccttcggcaccggcaccaagctgcaggtcatccccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 445 - DNA, 1827 bp, Homo sapiens
  TCR 28 Codon-optimized / cysteine-modified full sequence
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcctgtggggcagaagcagcggcaacaccatctacttcggcgagggcagctggctgaccgtggtcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatgatgatcagcctgcgggtgctgctggtcatcctgtggctgcagctgagctgggtctggtcccagcggaaagaggtggaacaggaccctggccccttcaacgtgccagagggcgctaccgtggccttcaactgcacctacagcaacagcgccagccagagcttcttctggtacagacaggactgccggaaagaacccaagctgctgatgagcgtgtacagcagcggcaacgaggacggcagattcaccgcccagctgaaccgggccagccagtacatctccctgctgatccgggacagcaagctgagcgacagcgccacctatctgtgtgtcgtgcggggaggcggcaccagctacggcaagctgacatttggccagggcaccatcctgaccgtgcaccccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 446 - DNA, 1836 bp, Homo sapiens
  TCR 29 Codon-optimized / cysteine-modified full sequence
atgagcaatcaggtgctgtgctgcgtggtcctgtgcctgctgggagccaataccgtggatggcggcatcacccagagccccaagtacctgttccggaaagagggccagaacgtcaccctgagctgcgagcagaacctgaaccacgacgccatgtactggtacagacaggaccccggccagggcctgcggctgatctactacagccagatcgtgaacgacttccagaagggcgacattgccgagggctacagcgtgtccagagagaagaaagagtccttcccactgaccgtgaccagcgcccagaagaaccccaccgccttctacctgtgtgccagctctccttggggcagagccaccaacgagcagttcttcggccctggcaccaggctgacagtgctggaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgcggctgaacaccggcaccgccagcaagctgaccttcggcacaggcaccagactgcaggtcacactggacatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 447 - DNA, 1818 bp, Homo sapiens
  TCR 30 Codon-optimized / cysteine-modified full sequence
atggatacctggctcgtgtgctgggccatcttcagcctgctgaaggccggactgaccgagcccgaagtgacccagacacccagccaccaggtcacacagatgggccaggaagtgatcctgcgctgcgtgcccatcagcaaccacctgtacttctactggtacagacagatcctgggccagaaggtggaattcctcgtcagcttctacaacaacgagatcagcgagaagtccgagattttcgacgaccagttcagcgtggaacggcccgacggcagcaacttcaccctgaagatcagaagcaccaagctcgaggacagcgccatgtacttttgcgccagcagcagacagcccagcagcggcaacaccatctacttcggcgagggcagctggctgaccgtggtcgaggacctgaataaggtgttcccccctgaggtggccgtgtttgagccaagcgaggccgagatctcccacacccagaaggccaccctggtgtgcctggcaaccggcttctttcccgatcacgtggagctgtcctggtgggtgaacggcaaggaggtgcactctggcgtgtgcacagacccacagcccctgaaggagcagcctgccctgaatgattcccgctattgtctgtcctctcggctgagagtgtctgccaccttttggcagaacccacggaatcacttcagatgccaggtgcagttttacggcctgtctgagaacgacgagtggacccaggatcgggccaagcctgtgacacagatcgtgagcgcggaagcatggggcagagccgactgtggcttcaccagcgtgtcctatcagcagggcgtgctgtccgccaccatcctgtacgagatcctgctgggcaaggccacactgtatgccgtgctggtgtctgccctggtgctgatggccatggtgaagagaaaagacttcggctctggcgccaccaactttagcctgctgaagcaggccggcgatgtggaggagaatcctggcccaatgcggctggtggccagagtgaccgtgttcctgaccttcggcaccatcatcgacgccaagaccacccagcctcccagcatggattgtgccgagggcagagccgccaacctgccctgcaatcacagcaccatcagcggcaacgagtacgtgtactggtacagacagatccacagccagggccctcagtacatcatccacggcctgaagaacaacgagacaaacgagatggccagcctgatcatcaccgaggacagaaagagcagcaccctgatcctgccccacgccaccctgagagacaccgccgtgtactactgtatcgtgcggggcacaagcgtgctgcagggcaacgagaagctgacatttggcaccggcacccggctgaccatcatccccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 448 - DNA, 1845 bp, Homo sapiens
  TCR 31 Codon-optimized / cysteine-modified full sequence
atgggcaccagactgctgttctgggtggccttctgcctgctgggagccgatcatacaggtgccggcgtgtcccagagccccagcaacaaagtgaccgagaagggcaaggacgtggaactgagatgcgaccccatcagcggccacaccgccctgtactggtacagacagtctctgggccagggcctggaattcctgatctattttcagggcaacagcgcccctgacaagagcggcctgcccagcgatagattcagcgccgagagaacaggcggcagcgtgtccaccctgaccatccagagaacccagcaggaagatagcgccgtctacctgtgcgccagcagcagattcctgggcagcaccgacacccagtacttcggcccaggcaccaggctgacagtgctggaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatggccatgctgctgggagcctctgtgctgatcctgtggctccagcccgactgggtcaacagccagcagaagaacgacgaccagcaggtcaaacagaacagccccagcctgagcgtgcaggaaggccggatcagcatcctgaactgcgactacaccaacagcatgttcgactactttctgtggtacaagaagtaccccgccgagggccccaccttcctgatctccatcagcagcatcaaggacaagaacgaggacggccggttcaccgtgtttctgaacaagagcgccaagcacctgagcctgcacatcgtgcctagccagcctggcgacagcgccgtgtacttttgtgccgccagcgagcggggcacctacaagtacatcttcggcaccggcacccggctgaaggtgctggctaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 449 - DNA, 1809 bp, Homo sapiens
  TCR 32 Codon-optimized / cysteine-modified full sequence
atgggcttcagactgctgtgctgcgtggccttctgtctgctgggagccggacctgtggatagcggcgtgacccagacccctaagcacctgatcaccgccaccggccagcgcgtgacactgagatgtagccctagaagcggcgacctgagcgtgtactggtatcagcagagcctggaccagggcctgcagttcctgatccagtactacaacggcgaggaacgggccaagggcaacatcctggaacggttcagcgcccagcagttccccgatctgcacagcgagctgaacctgagcagcctggaactgggcgacagcgccctgtacttctgtgcctcttctgtgggcggcgaccacagcgacgagcagttttttggccctggcacccggctgaccgtgctggaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatggtgctgaagttcagcgtgtccatcctgtggatccagctggcctgggtgtccacccagctgctggaacagagccctcagttcctgagcatccaggaaggcgagaacctgaccgtgtactgcaacagcagcagcgtgttcagcagcctgcagtggtacagacaggaacccggcgagggacctgtgctgctggtcacagtcgtgacaggcggcgaagtgaagaagctgaagcggctgaccttccagttcggcgacgccagaaaggacagctccctgcacattacagccgcccagcctggcgataccggcctgtatctgtgtgccggcggaagcaactacaagctgacctttggcaagggcaccctgctgaccgtgaaccccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 450 - DNA, 1830 bp, Homo sapiens
  TCR 33 Codon-optimized / cysteine-modified full sequence
atggatacctggctcgtgtgctgggccatcttcagcctgctgaaggccggactgaccgagcccgaagtgacccagacacccagccaccaggtcacacagatgggccaggaagtgatcctgcgctgcgtgcccatcagcaaccacctgtacttctactggtacagacagatcctgggccagaaggtggaattcctcgtcagcttctacaacaacgagatcagcgagaagtccgagattttcgacgaccagttcagcgtggaacggcccgacggcagcaacttcaccctgaagatcagaagcaccaagctcgaggacagcgccatgtacttttgcgccagcacccctcgggacacctacgagcagtacttcggccctggcaccagactgaccgtgaccgaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgatgaagtccctgcgggtgctgctggtcatcctgtggctgcagctgagctgggtctggtcccagcagaaagaggtggaacagaacagcggcccactgagcgtgccagagggcgctatcgccagcctgaactgcacctacagcgaccggggcagccagagcttcttctggtacagacagtacagcggcaagagccccgagctgatcatgttcatctacagcaacggcgacaaagaggacggccggttcaccgcccagctgaacaaggccagccagtacgtgtccctgctgatcagagacagccagcccagcgacagcgccacctacctgtgtgccgtgaatgcccaccacaccggcggcttcaagaccatctttggagccggcacccggctgttcgtgaaggccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 451 - DNA, 1806 bp, Homo sapiens
  TCR 34 Codon-optimized / cysteine-modified full sequence
atgggacctggactgctgtgttgggccctgctgtgtctgctgggagccggatctgtggaaaccggcgtgacccagagccccacccacctgatcaagaccagaggccagcaggtcacactgcggtgtagcagccagagcggccacaacaccgtgtcctggtatcagcaggccctgggccagggaccccagttcatcttccagtactaccgcgaggaagagaacggcagaggcaacttcccaccccggttcagcggcctgcagttccccaattacagcagcgagctgaacgtgaacgccctggaactggacgacagcgccctgtacctgtgcgcctctagcagctacgccggcagctacgagcagtacttcggccctggcaccagactgaccgtgaccgaagatctgaagaacgtcttcccccctgaggtggcagtctttgaaccctctgaggccgaaatcagtcacactcagaaagccaccctggtgtgcctggctacagggttttaccctgatcacgtggagctgagttggtgggtcaacggcaaggaagtgcattcaggggtctgcactgacccacagcccctgaaagagcagccagcactgaatgattccaggtactgtctgagttcacggctgagagtgtctgccacattttggcagaacccccgaaatcatttccggtgccaggtccagttttatggcctgagcgagaatgacgaatggacacaggatcgggctaagcccgtgactcagattgtctccgccgaggcttgggggagagcagactgtggattcacctccgaatcttaccagcagggcgtgctgtctgccaccatcctgtacgagattctgctggggaaggctacactgtatgccgtgctggtgagcgccctggtgctgatggcaatggtcaagagaaaagacagcaggggaggctctggcgccaccaactttagcctgctgaagcaggccggcgatgtggaggagaatcctggcccaatgaagaaactgctggccatgatcctgtggctgcagctggacagactgagcggcgagctgaaggtggaacagaaccctctgttcctgagcatgcaggaaggcaagaactacaccatctactgcaactacagcaccaccagcgaccggctgtactggtacagacaggaccccggcaagagcctggaaagcctgttcgtgctgctgagcaacggggccgtgaagcaggaaggacggctgatggccagcctggacaccaaggccagactgtccaccctgcacatcacagccgccgtgcacgacctgagcgccacctacttttgtgccgtgtccggcacctacaagtacatcttcggcaccggcaccagactgaaggtgctggccaatatccagaatcccgaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 452 - DNA, 1818 bp, Homo sapiens
  TCR 35 Codon-optimized / cysteine-modified full sequence
atgggctttagactgctgtgctgcgtggccttctgtctgcttggagctggccctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccagtactacaacggcgaggaaagagccaagggcaacatcctggaacggttcagcgcccagcagttcccagatctgcacagcgagctgaacctgagcagcctggaactgggagatagcgccctgtacttctgtgccagcaccacaagcggcgatagcagctacaacgagcagttcttcggccctggcaccagactgacagttctggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatggctctgcagtctacactgggagctgtgtggctgggcctgctgctgaattctctgtggaaggtggccgagagcaaggaccaggtgttccagccttctacagtggcctcttctgagggcgccgtggtggaaatcttctgcaaccacagcgtgtccaacgcctacaacttcttctggtatctgcacttccccggctgcgcccctagactgcttgtgaagggaagcaagcctagccagcagggcagatacaacatgacctacgagcggttcagcagctccctgctgattctgcaagtgcgggaagccgatgccgccgtgtattattgtgctgtggccggcgactacaagctgagctttggagccggcaccacagtgacagtgcgggctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 453 - DNA, 1824 bp, Homo sapiens
  TCR 36 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatgaccggcagaagcaactacgagcagtacttcggccctggcaccagactgacagtgacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgatgatcagcctgcgggtgctgctggtcatcctgtggctgcaactgagctgggtctggtcccagcggaaagaggtggaacaggaccccggacctttcaatgtgcctgaaggcgccaccgtggccttcaactgcacctacagcaatagcgccagccagagcttcttctggtacagacaggactgccggaaagaacccaagctgctgatgagcgtgtacagcagcggcaacgaggacggcagattcacagcccagctgaacagagccagccagtacatctccctgctgatccgggatagcaagctgagcgatagcgccacctacctgtgcgtggtcaacagagacaactacggccagaacttcgtgttcggccctggcacaagactgagcgtgctgccttatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 454 - DNA, 1812 bp, Homo sapiens
  TCR 37 Codon-optimized / cysteine-modified full sequence
atgggaacaagactgctgtgttgggtcgtgctgggcttcctgggcacagatcatacaggtgccggtgtctctcagagccccagatacaaggtggccaagcgcggacaggatgtggccctgagatgtgatcctatcagcggccacgtgtccctgttctggtatcagcaggctctcggacagggccccgagttcctgacctactttcagaatgaggcccagctggacaagagcggcctgcctagcgatagattcttcgccgaaagacccgagggcagcgtgtccacactgaagatccagagaacccagcaagaggacagcgccgtgtacctgtgtgcctctagtctgctgctgggcgcctacggctacacatttggctctggcaccagactgaccgtggtcgaggacctgaataaggtgttccctccagaggtggccgtgttcgagccttctgaggccgagatcagccacacacagaaagccacactcgtgtgcctggccaccggcttttttcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgtgtcctatcagcagggcgtgctgtctgccaccatcctgtatgagatcctgctgggcaaagccactctgtacgccgtgctggtgtctgccctggtgctgatggccatggtcaagagaaaggactttggcagcggcgccaccaacttcagcctgcttaaacaagctggcgacgtggaggagaatcctggcccaatgaagaaactgctggccatgatcctgtggctgcagctggatagactgagcggcgagctgaaggtggaacagaaccctctgttcctgagcatgcaagagggcaagaactacaccatctactgcaactacagcaccaccagcgaccggctgtactggtacagacaggatccaggcaagagcctggaaagcctgttcgtgctgctgagcaatggcgccgtgaaacaagagggtagactgatggccagcctggacaccaaggccagactgagcacactgcacattacagccgccgtgcacgatctgagcgccacctatttttgtgccggctactctggcgccggaagctaccagctgacatttggcaagggcaccaagctgagcgtgatccccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 455 - DNA, 1839 bp, Homo sapiens
  TCR 38 Codon-optimized / cysteine-modified full sequence
atgggacctggactgctttgttgggtgctgctgtgtctgctcggagccggatctgtggaaacaggcgtgacacagagccccacacacctgatcaagaccagaggccagcaagtgaccctgagatgcagctctcagagcggccacaataccgtgtcctggtatcagcaggccctcggacagggccctcagttcatcttccagtactacagagaggaagagaacggcagaggcaacttcccacctagattcagcggcctgcagttccccaactacagcagcgagctgaacgtgaacgccctggaactggatgacagcgccctgtacctgtgtgcctcttctcttgtggctggcggcgagacacagtactttggccccggaacaagactgctggtgctggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatggtcaagatgcctggcgctagacggcagagcatcatgaagagaattctgggcgccctgctgggcctgctgtctgcccaagtttgttgtgtgcggggcatccaggtggaacagagccctcctgatctgatcctgcaagagggcgccaacagcaccctgagatgcaacttcagcgacagcgtgaacaacctgcagtggttccaccagaatccttggggccagctgatcaacctgttctacatccccagcggcaccaagcagaacggcagactgtctgctaccaccgtggccaccgagagatacagcctgctgtacatcagcagcagccagaccacagacagcggcgtgtacttttgcgccgtgggcttcaacgacatgagattcggagccggcaccagactgaccgtgaagcctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 456 - DNA, 1779 bp, Homo sapiens
  TCR 39 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcacacccagagacagaggcaaagaggccttcttcggccaaggcaccagactgacagtggtcgaggacctgaataaggtgttccctccagaggtggccgtgttcgagccttctgaggccgagatcagccacacacagaaagccacactcgtgtgcctggccaccggcttttttcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgtgtcctatcagcagggcgtgctgtctgccaccatcctgtatgagatcctgctgggcaaagccactctgtacgccgtgctggtgtctgccctggtgctgatggccatggtcaagagaaaggactttggcagcggcgccaccaacttcagcctgcttaaacaagctggcgacgtggaggagaatcctggcccaatgcagctgacatgggtttccggccagcagctgaatcagagccctcagagcatgttcatccaagaaggcgaggacgtttccatgaactgcaccagcagcagcatcttcaacacctggctgtggtacaagcaagagcctggcgaaggacccgtgctgctgatcgctctttacaaggccggcgagctgaccagcaacggcagactgacagcccagttcggcattacccggaaggacagcttcctgaacatcagcgccagcattcccagcgacgtgggcatctatttctgcgccggctacagcagctccaacgactacaagctgagcttcggagccggcaccaccgtgacagttagagccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 457 - DNA, 1917 bp, Homo sapiens
  TCR 40 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatcaccgccagaagcagctacgagcagtatttcggccctggcaccagactgaccgtgacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgcacaccagcaccttccagaacagaccccagctgttcctgctgatctggaagaaactggtgcccggcaatcccttcaggcggtcttggatgaagcgcgagagagagatgctgctgatcacctccatgctggtgctgtggatgcagctgagccaagtgaacggccagcaagtgatgcagatccctcagtaccagcacgtgcaagaaggcgaggacttcaccacctactgcaacagcagcaccacactgagcaacatccagtggtacaagcagcggcctggcggacaccctgtgtttctgatccagctggtcaagtccggcgaagtgaagaagcagaagcggctgaccttccagttcggcgaggccaagaagaacagcagcctgcacatcaccgccacacagaccaccgatgtgggcacctacttttgcgccggcagaaacaacttcaacaagttctacttcggcagcggcaccaagctgaacgtgaagcccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 458 - DNA, 1833 bp, Homo sapiens
  TCR 41 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcaatccccgggacagagtgtcctacgagcagtactttggccctggcaccagactgaccgtgacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgatgatcagcctgcgggtgctgctggtcatcctgtggctgcaactgagctgggtctggtcccagcggaaagaggtggaacaggaccccggacctttcaatgtgcctgaaggcgccaccgtggccttcaactgcacctacagcaatagcgccagccagagcttcttctggtacagacaggactgccggaaagaacccaagctgctgatgagcgtgtacagcagcggcaacgaggacggcagattcacagcccagctgaacagagccagccagtacatctccctgctgatccgggatagcaagctgagcgatagcgccacctacctgtgcgtggtcacatttgctctgaccggcggcttcaagaccatcttcggagccggcaccagactgttcgtgaaggccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 459 - DNA, 1917 bp, Homo sapiens
  TCR 42 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccaagaccagcagaagcagctacgagcagtacttcggccctggcaccagactgacagtgacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgcacaccagcaccttccagaacagaccccagctgttcctgctgatctggaagaaactggtgcccggcaatcccttcaggcggtcttggatgaagcgcgagagagagatgctgctgatcacctccatgctggtgctgtggatgcagctgagccaagtgaacggccagcaagtgatgcagatccctcagtaccagcacgtgcaagaaggcgaggacttcaccacctactgcaacagcagcaccacactgagcaacatccagtggtacaagcagcggcctggcggacaccctgtgtttctgatccagctggtcaagtccggcgaagtgaagaagcagaagcggctgaccttccagttcggcgaggccaagaagaacagcagcctgcacatcaccgccacacagaccaccgatgtgggcacctacttttgcgccggacctgacaacttcaacaagttctacttcggcagcggcaccaagctgaacgtgaagcccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 460 - DNA, 1830 bp, Homo sapiens
  TCR 43 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcacacccagagacagctacgagcagtatttcggccctggcaccagactgaccgtgacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgttcatctacagcaacggcgacaaagaggacggccggtttacagcccagctgaacaaggccagccagtacgtgtccctgctgatcagagatagccagcctagcgacagcgccacctatctgtgtgccgtgaatgtgcctaccagcggcacctacaagtacatcttcggcaccggcaccagactgaaggtgctggctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 461 - DNA, 1851 bp, Homo sapiens
  TCR 44 Codon-optimized / cysteine-modified full sequence
atgggctttagactgctgtgctgcgtggccttctgtctgcttggagctggccctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccagtactacaacggcgaggaaagagccaagggcaacatcctggaacggttcagcgcccagcagttcccagatctgcacagcgagctgaacctgagcagcctggaactgggagatagcgccctgtacttctgtgccagcagcggcacacccgacacacagtattttggccctggcaccagactgaccgtgctggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatggctcaagagctgggcatgcagtgtcaggccagaggaatcctgcagcagatgtggggagtgttcctgctgtacgtgtccatgaagatgggcggcaccaccggccagaacatcgatcagcctacagagatgaccgccaccgagggcgccatcgtgcagatcaattgcacctaccagaccagcggcttcaacggcctgttctggtatcagcagcatgccggcgaggcccctaccttcctgagctacaatgtgctggacggcctggaagagaagggcagattcagcagcttcctgtccagaagcaagggctacagctacctgctgctgaaagaactgcagatgaaggacagcgcctcctacctgtgtgcccagtactctggcggctaccagaaagtgacctttggcaccggcaccaagctgcaagtgatccccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 462 - DNA, 1929 bp, Homo sapiens
  TCR 45 Codon-optimized / cysteine-modified full sequence
atgggaaccagactgctgttctgggtcgccttctgtctgctgggcgcctatcatacaggtgccggtgtctctcagagccccagcaacaaagtgaccgagaagggcaaagacgtggaactgagatgcgaccccatcagcggacacacagccctgtactggtacagacagagactcggccagggcctcgagttcctgatctacttccaaggcaacagcgcccctgacaagagcggcctgcctagcgatagattcagcgccgagagaacaggcgagagcgtgtccacactgaccatccagagaacccagcaagaggacagcgccgtgtacctgtgtgccagctctctgtacctgggaaccaccggcgagctgttctttggcgagggctctagactgaccgtgctggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgcacaccagcaccttccagaacagaccccagctgttcctgctgatctggaagaaactggtgcccggcaatcccttcaggcggtcttggatgaagcgcgagagagagatgctgctgatcacctccatgctggtgctgtggatgcagctgagccaagtgaacggccagcaagtgatgcagatccctcagtaccagcacgtgcaagaaggcgaggacttcaccacctactgcaacagcagcaccacactgagcaacatccagtggtacaagcagcggcctggcggacaccctgtgtttctgatccagctggtcaagtccggcgaagtgaagaagcagaagcggctgaccttccagttcggcgaggccaagaagaacagcagcctgcacatcaccgccacacagaccaccgatgtgggcacctatttttgcgccggatcttctggcgccggaagctaccagctgacatttggcaagggcaccaagctgagcgtgatccccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 463 - DNA, 1830 bp, Homo sapiens
  TCR 46 Codon-optimized / cysteine-modified full sequence
atgggaacaagactgctgtgttgggccgctctgtgtctgctgggagctgatcatacaggcgccggtgtcagccagacacctagcaacaaagtgaccgagaagggcaaatacgtggaactgagatgcgaccccatcagcggacacacagccctgtactggtacagacagtctctcggccagggacctgagttcctgatctacttccaaggcaccggcgctgccgatgatagcggcctgcctaacgatagattcttcgccgtcagacccgagggcagcgtgtccacactgaagatccagagaaccgagaggggcgacagcgccgtgtatctgtgtgccagctctctgtatctcggcggcagcgagacacagtactttggccctggtacacggctgctggttctggaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgctgctgcttctggtgcccgccttccaagtgatctttaccctcggcggaacacgggcccagtctgtgacacagctggattctcaggtgcccgtgtttgaggaagcccctgtcgagctgagatgcaactacagcagcagcgtgtccgtgtacctgttttggtacgtgcagtaccccaaccagggcctgcagctgctgctcaagtatctgagcggcagcacactggtcaagggcatcaatggcttcgaggccgagttcaacaagagccagaccagcttccatctgcggaagcccagcgtgcacatcagcgataccgccgagtacttctgcgccgtgtctcctagcagcggcacctacaagtacatcttcggcaccggcaccagactgaaggtgctggctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 464 - DNA, 1830 bp, Homo sapiens
  TCR 47 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatgaccggcagaaccacctacgagcagtatttcggccctggcaccagactgaccgtgacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgttcatctacagcaacggcgacaaagaggacggccggtttacagcccagctgaacaaggccagccagtacgtgtccctgctgatcagagatagccagcctagcgacagcgccacctatctgtgtgccgtgaatctgctgagcggcagcgctagacagctgacatttggctctggcacccagctgaccgtgctgcctgatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 465 - DNA, 1824 bp, Homo sapiens
  TCR 48 Codon-optimized / cysteine-modified full sequence
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcaccggcagagtgtcctacgagcagtatttcggccctggcaccagactgaccgtgacagaagatctgaagaacgtcttcccacctgaggtggccgtgttcgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggctggcgacgtggaggagaatcctggcccaatgatgaagtccctgcgggtgctgctggtcatcctgtggctgcaactgagctgggtctggtcccagcagaaagaggtggaacaggaccctggacctctgtctgttcctgagggcgccatcgtgtccctgaactgcacctacagcaacagcgccttccagtacttcatgtggtacagacagtacagccggaagggccccgagctgctgatgtacacatacagcagcggcaacaaagaggacggccggtttacagcccaggtggacaagagcagcaagtacatctccctgttcatccgggacagccagcctagcgatagcgccacatatctgtgcgccatgagaatccagggcgcccagaaactggtgttcggccagggaaccagactgaccatcaatcccaacatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 466 - DNA, 1830 bp, Homo sapiens
  TCR 49 Codon-optimized / cysteine-modified full sequence
atggatacctggctcgtgtgctgggccatcttcagcctgctgaaagccggactgaccgagcctgaagtgacccagacacctagccaccaagtgacacagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcacaccccggtacagctacgagcagtatttcggccctggcaccagactgaccgtgacagaagatctgaagaacgtcttccctcctgaagtggccgtgtttgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggccggcgacgtggaggagaatcctggcccaatgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgttcatctacagcaacggcgacaaagaggacggccggtttacagcccagctgaacaaggccagccagtacgtgtccctgctgatcagagatagccagcctagcgacagcgccacctatctgtgcgccgtgaatatcggcaccagcggcacctacaagtacatcttcggcaccggcaccagactgaaggtgctggctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 467 - DNA, 1815 bp, Homo sapiens
  TCR 50 Codon-optimized / cysteine-modified full sequence
atgggcttcagactgctgtgctgcgtggccttttgtctgcttggagccggacctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccactactacaacggcgaggaaagagccaagggcaacatcctggaacggttcagcgcccagcagttcccagatctgcacagcgagctgaacctgagcagcctggaactgggagatagcgccctgtacttctgtgccagcagcgccacaagagatgcctacggctacacatttggcagcggcaccagactgacagtggtggaggacctgaataaggtgttccctcctgaagtggccgtgtttgagccttctgaggccgagatcagccacacacagaaagccacactcgtgtgcctggccaccggcttttttcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgtgtcctatcagcagggcgtgctgtctgccaccatcctgtatgagatcctgctgggcaaagccactctgtacgccgtgctggtgtctgccctggtgctgatggccatggtcaagagaaaggactttggcagcggcgccaccaacttcagcctgcttaaacaggcaggcgacgtggaggagaatcctggcccaatgaagaccttcgccggcttcagcttcctgttcctgtggctgcagctggactgcatgagcagaggcgaggatgtggaacagagcctgtttctgagcgtccgcgagggcgatagcagcgtgatcaattgcacctacaccgacagcagcagcacctacctgtactggtacaagcaagagcctggcgccggactgcagctgctgacctacatcttcagcaacatggacatgaagcaggaccagcggctgaccgtgctgctgaacaagaaggacaagcacctgagcctgcggatcgccgatacacagacaggcgacagcgccatctacttttgcgccgagtctcctccaggcacctacaagtacatcttcggcaccggcaccagactgaaggtgctggctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 468 - DNA, 1833 bp, Homo sapiens
  TCR 51 Codon-optimized / cysteine-modified full sequence
atggatacctggctcgtgtgctgggccatcttcagcctgctgaaagccggactgaccgagcctgaagtgacccagacacctagccaccaagtgacacagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccattgccagccgggtgtcctacgagcagtatttcggccctggcaccagactgaccgtgacagaagatctgaagaacgtcttccctcctgaagtggccgtgtttgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggccggcgacgtggaggagaatcctggcccaatgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgagcatctacagcaacggcgacaaagaggacggccggtttacagcccagctgaacaaggccagccagtacgtgtccctgctgatcagagatagccagcctagcgacagcgccacctatctgtgcgccgtgaatatgagaggcggcggaagcaactacaagctgacctttggcaagggcaccctgctgaccgtgaatcccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 469 - DNA, 1806 bp, Homo sapiens
  TCR 52 Codon-optimized / cysteine-modified full sequence
atgggcttcagactgctgtgctgcgtggccttttgtctgcttggagccggacctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccagtactacaacggcgaggaaagagccaagggcaacatcctggaacggttcagcgcccagcagttcccagatctgcacagcgagctgaacctgagcagcctggaactgggagatagcgccctgtacttctgtgccagctctgtgggcgatctgaacaacgagcagttcttcggccctggcaccagactgacagttctggaagatctgaagaacgtcttccctcctgaagtggccgtgtttgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggccggcgacgtggaggagaatcctggcccaatggtgctgaagttcagcgtgtccatcctgtggatccagctggcctgggtttccacacagctgctggaacagagccctcagttcctgagcatccaagagggcgagaacctgaccgtgtactgcaacagcagcagcgtgttcagcagcctgcagtggtacagacaagagcctggcgaaggacctgtgctgctggtcacagttgtgacaggcggcgaagtgaagaagctgaagcggctgaccttccagttcggcgacgccagaaaggatagctccctgcacattaccgctgctcagccaggcgataccggcctgtatctttgtgccggcgctcgggattacaagctgtcttttggcgccggaaccaccgtgacagtgcgggctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 470 - DNA, 1836 bp, Homo sapiens
  TCR 53 Codon-optimized / cysteine-modified full sequence
atgggcacaagcctgctgtgttgggtcgtgctgggctttctgggcacagatcatacaggcgccggtgtcagccagtctcctcggtacaaagtgaccaagcgcggacaggatgtggccctgagatgcgatcctatctctggccacgtgtccctgtactggtacagacaggctctcggacagggccccgagttcctgacctacttcaattacgaggcccagcaggacaagagcggcctgcctaacgatagattcagcgccgaaagacccgagggcagcatcagcacactgaccatccagagaaccgagcagagggacagcgccatgtacagatgtgcctctagcggcagcggcaccagcggctacaatgagcagtttttcggccctggcaccagactgacagtgctggaagatctgaagaacgtcttccctcctgaagtggccgtgtttgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggccggcgacgtggaggagaatcctggcccaatggccagcgctcctatctctatgctggccatgctgttcaccctgagcggactgagagcacagtctgtggcccagcctgaggaccaagtgaatgtggccgagggcaatcccctgaccgtgaagtgtacctacagcgtgtccggcaatccctacctgttttggtacgtgcagtaccccaaccggggcctgcagttcctgctgaagtacatcaccggcgacaacctggtcaagggcagctatggattcgaggccgagttcaacaagagccagaccagcttccacctgaagaaacccagcgctctggtgtccgatagcgccctgtatttctgcgccgtcagagattttggcagcggcacctacaagtacatcttcggcaccggcaccagactgaaggtgctggctaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 471 - DNA, 1821 bp, Homo sapiens
  TCR 54 Codon-optimized / cysteine-modified full sequence
atggatacttggctcgtgtgctgggccatcttcagcctgctgaaagccggactgaccgagcctgaagtgacacagacacctagccaccaagtgacccagatgggccaagaggtcatactgagatgcgtgcccatcagcaaccacctgtacttctactggtacagacagatcctgggccagaaggtggaattcctcgtcagcttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatcaccgaccggaccaactacggctacacatttggcagcggcaccagactgacagtggtcgaggacctgaataaggtgttccctcctgaagtggccgtgtttgagccttctgaggccgagatcagccacacacagaaagccacactcgtgtgcctggccaccggcttttttcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgtgtcctatcagcagggcgtgctgtctgccaccatcctgtatgagatcctgctgggcaaagccactctgtacgccgtgctggtgtctgccctggtgctgatggccatggtcaagagaaaggactttggcagcggcgccaccaacttcagcctgcttaaacaggcaggcgacgtggaggagaatcctggcccaatgaagaagcacctgaccacctttctggtcatcctgtggctgtacttctacagaggcaacggcaagaaccaggtggaacagagccctcagagcctgatcatcctggaaggcaagaactgcaccctgcagtgcaactacaccgtgtctcccttcagcaacctgcggtggtacaagcaggatacaggcagaggccctgtgtctctgaccatcatgaccttcagcgagaacaccaagagcaacggcagatacaccgccacactggacgccgatacaaagcagagcagcctgcacatcacagccagccagctgagcgatagcgccagctacatctgcgtggtgtccagagacaactacggccagaacttcgtgttcggccctggcacaagactgagcgtgctgccttatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 472 - DNA, 1821 bp, Homo sapiens
  TCR 55 Codon-optimized / cysteine-modified full sequence
atggatacttggctcgtgtgctgggccatcttcagcctgctgaaagccggactgaccgagcctgaagtgacacagacacctagccaccaagtgacccagatgggccaagaggtcatactgagatgcgtgcccatcagcaaccacctgtacttctactggtacagacagatcctgggccagaaggtggaattcctcgtcagcttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcaccaccagaagcagctacgagcagtatttcggccctggcaccagactgaccgtgacagaagatctgaagaacgtcttccctcctgaagtggccgtgtttgagccttctgaggccgagatcagccacacacagaaagccacactcgtgtgtctggccaccggcttctatcccgatcacgtggaactgtcttggtgggtcaacggcaaagaggtgcacagcggcgtctgtaccgatcctcagcctctgaaagagcagcccgctctgaacgacagcagatactgcctgagcagcagactgagagtgtccgccaccttctggcagaaccccagaaaccacttcagatgccaggtgcagttctacggcctgagcgagaacgatgagtggacccaggatagagccaagcctgtgacacagatcgtgtctgccgaagcctggggcagagccgattgtggctttaccagcgagagctaccagcagggcgtgctgtctgccacaatcctgtacgagatcctgctgggcaaagccactctgtacgccgtgctggtgtctgccctggtgctgatggccatggtcaagcggaaggatagcagaggcggaagcggcgccacaaacttctcactgctgaaacaggccggcgacgtggaggagaatcctggcccaatgaagaccttcgccggcttcagcttcctgttcctgtggctgcagctggactgtatgagcagaggcgaggatgtggaacagagcctgtttctgagcgtcagagaaggcgacagcagcgtgatcaactgcacctacaccgacagctccagcacctacctgtactggtacaagcaagaacctggcgccggactgcagctgctgacctacatcttcagcaacatggacatgaagcaggaccagcggctgaccgtgctgctgaacaagaaggataagcacctgagcctgcggatcgccgatacacagacaggcgactccgccatctacttttgtgctgtgcctagcggcgccaccaacaagctgatctttggaacaggcacactgctggccgtgcagcccaatatccagaatccggaccctgccgtctaccagctgagggactcaaagagctccgataaaagcgtgtgcctgttcaccgactttgattctcagacaaacgtcagccagtccaaggacagtgacgtgtacattacagacaaatgcgtgctggatatgcgctccatggacttcaagtctaacagtgcagtggcctggtccaacaagtctgatttcgcttgcgcaaacgcctttaacaattcaatcattccagaggataccttctttccaagccccgaatctagttgtgacgtgaagctggtcgagaaatctttcgaaacagatactaacctgaattttcagaatctgagcgtgatcggcttccgcattctgctgctgaaagtggctgggtttaatctgctgatgactctgcggctgtggtcttcctaa

SEQ ID NO: 473 - protein, 255 aa, Homo sapiens
  TCR 15 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMKPGGYNKLIFGAGTRLAVHPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 474 - protein, 255 aa, Homo sapiens
  TCR 15 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMKPGGYNKLIFGAGTRLAVHPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 475 - protein, 275 aa, Homo sapiens
  TCR 15 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMKPGGYNKLIFGAGTRLAVHPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 476 - protein, 275 aa, Homo sapiens
  TCR 15 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMKPGGYNKLIFGAGTRLAVHPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 477 - protein, 114 aa, Homo sapiens
  TCR 15 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMKPGGYNKLIFGAGTRLAVHP

SEQ ID NO: 478 - protein, 11 aa, Homo sapiens
  TCR 15 alpha CDR3
AMKPGGYNKLI

SEQ ID NO: 479 - protein, 294 aa, Homo sapiens
  TCR 15 - Beta Native
DAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLVGRSRTEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 480 - protein, 294 aa, Homo sapiens
  TCR 15 - Beta Cysteine-modified
DAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLVGRSRTEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 481 - protein, 313 aa, Homo sapiens
  TCR 15 - Beta Native
MDSWTFCCVSLCILVAKHTDAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLVGRSRTEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 482 - protein, 313 aa, Homo sapiens
  TCR 15 - Beta Cysteine-modified
MDSWTFCCVSLCILVAKHTDAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLVGRSRTEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 483 - protein, 115 aa, Homo sapiens
  TCR 15 Beta variable region
DAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLVGRSRTEQYFGPGTRLTVT

SEQ ID NO: 484 - protein, 5 aa, Homo sapiens
  TCR 15 Beta CDR1
SGHNS

SEQ ID NO: 485 - protein, 6 aa, Homo sapiens
  TCR 15 Beta CDR2
FNNNVP

SEQ ID NO: 486 - protein, 13 aa, Homo sapiens
  TCR 15 Beta CDR3
ASSLVGRSRTEQY

SEQ ID NO: 487 - protein, 19 aa, Homo sapiens
  TCR 15 - Beta signal peptide
MDSWTFCCVSLCILVAKHT

SEQ ID NO: 488 - protein, 253 aa, Homo sapiens
  TCR 16 - Alpha Native
KQEVTQIPAALSVPEGENLVLNCSFTDSAIYNLQWFRQDPGKGLTSLLLIQSSQREQTSGRLNASLDKSSGRSTLYIAASQPGDSATYLCAVRPANNNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 489 - protein, 253 aa, Homo sapiens
  TCR 16 - Alpha Cysteine-modified
KQEVTQIPAALSVPEGENLVLNCSFTDSAIYNLQWFRQDPGKGLTSLLLIQSSQREQTSGRLNASLDKSSGRSTLYIAASQPGDSATYLCAVRPANNNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 490 - protein, 272 aa, Homo sapiens
  TCR 16 - Alpha Native
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPANNNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 491 - protein, 272 aa, Homo sapiens
  TCR 16 - Alpha Cysteine-modified
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPANNNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 492 - protein, 112 aa, Homo sapiens
  TCR 16 Alpha variable region
KQEVTQIPAALSVPEGENLVLNCSFTDSAIYNLQWFRQDPGKGLTSLLLIQSSQREQTSGRLNASLDKSSGRSTLYIAASQPGDSATYLCAVRPANNNDMRFGAGTRLTVKP

SEQ ID NO: 493 - protein, 11 aa, Homo sapiens
  TCR 16 alpha CDR3
AVRPANNNDMR

SEQ ID NO: 494 - protein, 291 aa, Homo sapiens
  TCR 16 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 495 - protein, 291 aa, Homo sapiens
  TCR 16 / TCR 17 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 496 - protein, 310 aa, Homo sapiens
  TCR 16 / TCR 17 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 497 - protein, 310 aa, Homo sapiens
  TCR 16 / TCR 17 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 498 - protein, 114 aa, Homo sapiens
  TCR 16 / TCR 17 - Beta variable region
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSNQPQHFGDGTRLSIL

SEQ ID NO: 499 - protein, 13 aa, Homo sapiens
  TCR 16 / TCR 17  Beta CDR3
ASSLWGRSNQPQH

SEQ ID NO: 500 - protein, 255 aa, Homo sapiens
  TCR 17 - Alpha Native
AQKITQTQPGMFVQEKEAVTLDCTYDTSDPSYGLFWYKQPSSGEMIFLIYQGSYDQQNATEGRYSLNFQKARKSANLVISASQLGDSAMYFCAMREGRGDKIIFGKGTRLHILPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 501 - protein, 255 aa, Homo sapiens
  TCR 17 - Alpha Cysteine-modified
AQKITQTQPGMFVQEKEAVTLDCTYDTSDPSYGLFWYKQPSSGEMIFLIYQGSYDQQNATEGRYSLNFQKARKSANLVISASQLGDSAMYFCAMREGRGDKIIFGKGTRLHILPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 502 - protein, 275 aa, Homo sapiens
  TCR 17 - Alpha Native
MSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMREGRGDKIIFGKGTRLHILPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 503 - protein, 275 aa, Homo sapiens
  TCR 17 - Alpha Cysteine-modified
MSLSSLLKVVTASLWLGPGIAQKITQTQPGMFVQEKEAVTLDCTYDTSDPSYGLFWYKQPSSGEMIFLIYQGSYDQQNATEGRYSLNFQKARKSANLVISASQLGDSAMYFCAMREGRGDKIIFGKGTRLHILPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 504 - protein, 114 aa, Homo sapiens
  TCR 17 - Alpha variable region
AQKITQTQPGMFVQEKEAVTLDCTYDTSDPSYGLFWYKQPSSGEMIFLIYQGSYDQQNATEGRYSLNFQKARKSANLVISASQLGDSAMYFCAMREGRGDKIIFGKGTRLHILP

SEQ ID NO: 505 - protein, 11 aa, Homo sapiens
  TCR 17 Alpha CDR3
AMREGRGDKII

SEQ ID NO: 506 - protein, 256 aa, Homo sapiens
  TCR 18 - Alpha Native
KQEVTQIPAALSVPEGENLVLNCSFTDSAIYNLQWFRQDPGKGLTSLLLIQSSQREQTSGRLNASLDKSSGRSTLYIAASQPGDSATYLCAEGNAGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 507 - protein, 256 aa, Homo sapiens
  TCR 18 - Alpha Cysteine-modified
KQEVTQIPAALSVPEGENLVLNCSFTDSAIYNLQWFRQDPGKGLTSLLLIQSSQREQTSGRLNASLDKSSGRSTLYIAASQPGDSATYLCAEGNAGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 508 - protein, 275 aa, Homo sapiens
  TCR 18 - Alpha Native
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAEGNAGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 509 - protein, 275 aa, Homo sapiens
  TCR 18 - Alpha Cysteine-modified
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAEGNAGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 510 - protein, 115 aa, Homo sapiens
  TCR 18 Alpha variable region
KQEVTQIPAALSVPEGENLVLNCSFTDSAIYNLQWFRQDPGKGLTSLLLIQSSQREQTSGRLNASLDKSSGRSTLYIAASQPGDSATYLCAEGNAGGTSYGKLTFGQGTILTVHP

SEQ ID NO: 511 - protein, 14 aa, Homo sapiens
  TCR 18 Alpha CDR3
AEGNAGGTSYGKLT

SEQ ID NO: 512 - protein, 291 aa, Homo sapiens
  TCR 18 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSFWGRSNSPLHFGNGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 513 - protein, 291 aa, Homo sapiens
  TCR 18 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSFWGRSNSPLHFGNGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 514 - protein, 310 aa, Homo sapiens
  TCR 18 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSFWGRSNSPLHFGNGTRLTVTEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 515 - protein, 310 aa, Homo sapiens
  TCR 18 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSFWGRSNSPLHFGNGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 516 - protein, 114 aa, Homo sapiens
  TCR 18 Beta variable region
DVKVTQSSRYLVKRTGEKVFLECVQDMDHENMFWYRQDPGLGLRLIYFSYDVKMKEKGDIPEGYSVSREKKERFSLILESASTNQTSMYLCASSFWGRSNSPLHFGNGTRLTVT

SEQ ID NO: 517 - protein, 13 aa, Homo sapiens
  TCR 18 Beta CDR3
ASSFWGRSNSPLH

SEQ ID NO: 518 - protein, 257 aa, Homo sapiens
  TCR 19 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRENTGTASKLTFGTGTRLQVTLDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 519 - protein, 257 aa, Homoe sapiens
  TCR 19 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRENTGTASKLTFGTGTRLQVTLDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 520 - protein, 277 aa, Homo sapiens
  TCR 19 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRENTGTASKLTFGTGTRLQVTLDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 521 - protein, 277 aa, Homo sapiens
  TCR 19 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRENTGTASKLTFGTGTRLQVTLDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 522 - protein, 116 aa, Homo sapiens
  TCR 19 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRENTGTASKLTFGTGTRLQVTL

SEQ ID NO: 523 - protein, 13 aa, Homo sapiens
  TCR 19  Alpha CDR3
AMRENTGTASKLT

SEQ ID NO: 524 - protein, 141 aa, Homo sapiens
  TCR 19/ TCR 22/ TCR 23/ TCR 24/ TCR 25/ TCR 47 Native TCR alpha constant region
DIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 525 - protein, 141 aa, Homo sapiens
  TCR 19/ TCR 22/ TCR 23/ TCR 24/ TCR 25/ TCR 29/ TCR 47 Alpha constant region
DIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 526 - protein, 293 aa, Homo sapiens
  TCR 19 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSSWGQSTGEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 527 - protein, 293 aa, Homo sapiens
  TCR 19 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSSWGQSTGEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 528 - protein, 312 aa, Homo sapiens
  TCR 19 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSSWGQSTGEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 529 - protein, 312 aa, Homo sapiens
  TCR 19 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSSWGQSTGEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 530 - protein, 114 aa, Homo sapiens
  TCR 19 Beta variable region
DVKVTQSSRYLVKRTGEKVFLECVQDMDHENMFWYRQDPGLGLRLIYFSYDVKMKEKGDIPEGYSVSREKKERFSLILESASTNQTSMYLCASSSWGQSTGEQYFGPGTRLTVT

SEQ ID NO: 531 - protein, 13 aa, Homo sapiens
  TCR 19 Beta CDR3
ASSSWGQSTGEQY

SEQ ID NO: 532 - protein, 254 aa, Homo sapiens
  TCR 20 - Alpha Native
AQKVTQAQTEISVVEKEDVTLDCVYETRDTTYYLFWYKQPPSGELVFLIRRNSFDEQNEISGRYSWNFQKSTSSFNFTITASQVVDSAVYFCALWTGANNLFFGTGTRLTVIPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 533 - protein, 254 aa, Homo sapiens
  TCR 20 - Alpha Cysteine-modified
AQKVTQAQTEISVVEKEDVTLDCVYETRDTTYYLFWYKQPPSGELVFLIRRNSFDEQNEISGRYSWNFQKSTSSFNFTITASQVVDSAVYFCALWTGANNLFFGTGTRLTVIPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 534 - protein, 276 aa, Homo sapiens
  TCR 20 - Alpha Native
MNMLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALWTGANNLFFGTGTRLTVIPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 535 - protein, 276 aa, Homo sapiens
  TCR 20 - Alpha Cysteine-modified
MNMLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALWTGANNLFFGTGTRLTVIPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 536 - protein, 113 aa, Homo sapiens
  TCR 20 Alpha variable region
AQKVTQAQTEISVVEKEDVTLDCVYETRDTTYYLFWYKQPPSGELVFLIRRNSFDEQNEISGRYSWNFQKSTSSFNFTITASQVVDSAVYFCALWTGANNLFFGTGTRLTVIP

SEQ ID NO: 537 - protein, 7 aa, Homo sapiens
  TCR 20 Alpha CDR1
TRDTTYY

SEQ ID NO: 538 - protein, 8 aa, Homo sapiens
  TCR 20 Alpha CDR2
RNSFDEQN

SEQ ID NO: 539 - protein, 10 aa, Homo sapiens
  TCR 20 Alpha CDR3
ALWTGANNLF

SEQ ID NO: 540 - protein, 22 aa, Homo sapiens
  TCR 20 alpha signal peptide
MNMLTASLLRAVIASICVVSSM

SEQ ID NO: 541 - protein, 296 aa, Homo sapiens
  TCR 20 - Beta Native
GAVVSQHPSRVICKSGTSVKIECRSLDFQATTMFWYRQFPKQSLMLMATSNEGSKATYEQGVEKDKFLINHASLTLSTLTVTSAHPEDSSFYICSASSLARRSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 542 - protein, 296 aa, Homo sapiens
  TCR 20 - Beta Cysteine-modified
GAVVSQHPSRVICKSGTSVKIECRSLDFQATTMFWYRQFPKQSLMLMATSNEGSKATYEQGVEKDKFLINHASLTLSTLTVTSAHPEDSSFYICSASSLARRSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 543 - protein, 310 aa, Homo sapiens
  TCR 20 - Beta Native
MLLLLLLLGPGSGLGAVVSQHPSRVICKSGTSVKIECRSLDFQATTMFWYRQFPKQSLMLMATSNEGSKATYEQGVEKDKFLINHASLTLSTLTVTSAHPEDSSFYICSASSLARRSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 544 - protein, 310 aa, Homo sapiens
  TCR 20 - Beta Cysteine-modified
MLLLLLLLGPGSGLGAVVSQHPSRVICKSGTSVKIECRSLDFQATTMFWYRQFPKQSLMLMATSNEGSKATYEQGVEKDKFLINHASLTLSTLTVTSAHPEDSSFYICSASSLARRSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 545 - protein, 117 aa, Homo sapiens
  TCR 20 Beta variable region
GAVVSQHPSRVICKSGTSVKIECRSLDFQATTMFWYRQFPKQSLMLMATSNEGSKATYEQGVEKDKFLINHASLTLSTLTVTSAHPEDSSFYICSASSLARRSYEQYFGPGTRLTVT

SEQ ID NO: 546 - protein, 6 aa, Homo sapiens
  TCR 20 Beta CDR1
DFQATT

SEQ ID NO: 547 - protein, 7 aa, Homo sapiens
  TCR 20 Beta CDR2
SNEGSKA

SEQ ID NO: 548 - protein, 13 aa, Homo sapiens
  TCR 20 Beta CDR3
SASSLARRSYEQY

SEQ ID NO: 549 - protein, 14 aa, Homo sapiens
  TCR 20 beta signal peptide
MLLLLLLLGPGSGL

SEQ ID NO: 550 - protein, 259 aa, Homo sapiens
  TCR 21 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRVTGGGNKLTFGTGTQLKVELNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 551 - protein, 259 aa, Homo sapiens
  TCR 21 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRVTGGGNKLTFGTGTQLKVELNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 552 - protein, 279 aa, Homo sapiens
  TCR 21 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRVTGGGNKLTFGTGTQLKVELNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 553 - protein, 279 aa, Homo sapiens
  TCR 21 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRVTGGGNKLTFGTGTQLKVELNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 554 - protein, 118 aa, Homo sapiens
  TCR 21 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRVTGGGNKLTFGTGTQLKVEL

SEQ ID NO: 555 - protein, 15 aa, Homo sapiens
  TCR 21 Alpha CDR3
AMREGRVTGGGNKLT

SEQ ID NO: 556 - protein, 291 aa, Homo sapiens
  TCR 21 - Beta Native
NAGVTQTPKFQVLKTGQSMTLQCAQDMNHNSMYWYRQDPGMGLRLIYYSASEGTTDKGEVPNGYNVSRLNKREFSLRLESAAPSQTSVYFCASRPWGNQNTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 557 - protein, 291 aa, Homo sapiens
  TCR 21 - Beta Cysteine-modified
NAGVTQTPKFQVLKTGQSMTLQCAQDMNHNSMYWYRQDPGMGLRLIYYSASEGTTDKGEVPNGYNVSRLNKREFSLRLESAAPSQTSVYFCASRPWGNQNTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 558 - protein, 324 aa, Homo sapiens
  TCR 21 - Beta Native
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASRPWGNQNTEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 559 - protein, 324 aa, Homo sapiens
  TCR 21 - Beta Cysteine-modified
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASRPWGNQNTEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 560 - protein, 114 aa, Homo sapiens
  TCR 21 Beta variable region
NAGVTQTPKFQVLKTGQSMTLQCAQDMNHNSMYWYRQDPGMGLRLIYYSASEGTTDKGEVPNGYNVSRLNKREFSLRLESAAPSQTSVYFCASRPWGNQNTEAFFGQGTRLTVV

SEQ ID NO: 561 - protein, 5 aa, Homo sapiens
  TCR 21/ TCR 27 Beta CDR1
MNHNS

SEQ ID NO: 562 - protein, 6 aa, Homo sapiens
  TCR 21/ TCR 27 Beta CDR2
SASEGT

SEQ ID NO: 563 - protein, 13 aa, Homo sapiens
  TCR 21 Beta CDR3
ASRPWGNQNTEAF

SEQ ID NO: 564 - protein, 33 aa, Homo sapiens
  TCR 21/ TCR 27 Beta signal peptide
MHRPRRPLHPVAPAMSIGLLCCVAFSLLWASPV

SEQ ID NO: 565 - protein, 253 aa, Homo sapiens
  TCR 22 - Alpha Native
GQNIDQPTEMTATEGAIVQINCTYQTSGFNGLFWYQQHAGEAPTFLSYNVLDGLEEKGRFSSFLSRSKGYSYLLLKELQMKDSASYLCAVRARMDSNYQLIWGAGTKLIIKPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 566 - protein, 253 aa, Homo sapiens
  TCR 22 - Alpha Cysteine-modified
GQNIDQPTEMTATEGAIVQINCTYQTSGFNGLFWYQQHAGEAPTFLSYNVLDGLEEKGRFSSFLSRSKGYSYLLLKELQMKDSASYLCAVRARMDSNYQLIWGAGTKLIIKPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 567 - protein, 287 aa, Homo sapiens
  TCR 22 - Alpha Native
MAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVRARMDSNYQLIWGAGTKLIIKPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 568 - protein, 287 aa, Homo sapiens
  TCR 22 - Alpha Cysteine-modified
MAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVRARMDSNYQLIWGAGTKLIIKPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 569 - protein, 112 aa, Homo sapiens
  TCR 22 Alpha variable region
GQNIDQPTEMTATEGAIVQINCTYQTSGFNGLFWYQQHAGEAPTFLSYNVLDGLEEKGRFSSFLSRSKGYSYLLLKELQMKDSASYLCAVRARMDSNYQLIWGAGTKLIIKP

SEQ ID NO: 570 - protein, 6 aa, Homo sapiens
  TCR 22/ TCR 44 Alpha CDR1
TSGFNG

SEQ ID NO: 571 - protein, 6 aa, Homo sapiens
  TCR 22/ TCR 44 Alpha CDR2
NVLDGL

SEQ ID NO: 572 - protein, 13 aa, Homo sapiens
  TCR 22 Alpha CDR3
AVRARMDSNYQLI

SEQ ID NO: 573 - protein, 34 aa, Homo sapiens
  TCR 22/ TCR 44Alpha signal peptide
MAQELGMQCQARGILQQMWGVFLLYVSMKMGGTT

SEQ ID NO: 574 - protein, 289 aa, Homo sapiens
  TCR 22 - Beta Native
DAGVTQSPTHLIKTRGQHVTLRCSPISGHKSVSWYQQVLGQGPQFIFQYYEKEERGRGNFPDRFSARQFPNYSSELNVNALLLGDSALYLCASSRTENYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 575 - protein, 289 aa, Homo sapiens
  TCR 22 - Beta Cysteine-modified
DAGVTQSPTHLIKTRGQHVTLRCSPISGHKSVSWYQQVLGQGPQFIFQYYEKEERGRGNFPDRFSARQFPNYSSELNVNALLLGDSALYLCASSRTENYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 576 - protein, 308 aa, Homo sapiens
  TCR 22 - Beta Native
MGPGLLCWVLLCLLGAGPVDAGVTQSPTHLIKTRGQHVTLRCSPISGHKSVSWYQQVLGQGPQFIFQYYEKEERGRGNFPDRFSARQFPNYSSELNVNALLLGDSALYLCASSRTENYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 577 - protein, 308 aa, Homo sapiens
  TCR 22 - Beta Cysteine-modified
MGPGLLCWVLLCLLGAGPVDAGVTQSPTHLIKTRGQHVTLRCSPISGHKSVSWYQQVLGQGPQFIFQYYEKEERGRGNFPDRFSARQFPNYSSELNVNALLLGDSALYLCASSRTENYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 578 - protein, 112 aa, Homo sapiens
  TCR 22 Beta variable region
DAGVTQSPTHLIKTRGQHVTLRCSPISGHKSVSWYQQVLGQGPQFIFQYYEKEERGRGNFPDRFSARQFPNYSSELNVNALLLGDSALYLCASSRTENYGYTFGSGTRLTVV

SEQ ID NO: 579 - protein, 5 aa, Homo sapiens
  TCR 22 Beta CDR1
SGHKS

SEQ ID NO: 580 - protein, 6 aa, Homo sapiens
  TCR 22 Beta CDR2
YYEKEE

SEQ ID NO: 581 - protein, 11 aa, Homo sapiens
  TCR 22 Beta CDR3
ASSRTENYGYT

SEQ ID NO: 582 - protein, 19 aa, Homo sapiens
  TCR 22 Beta signal peptide
MGPGLLCWVLLCLLGAGPV

SEQ ID NO: 583 - protein, 257 aa, Homo sapiens
  TCR 23 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMSPPGGSARQLTFGSGTQLTVLPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 584 - protein, 257 aa, Homo sapiens
  TCR 23 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMSPPGGSARQLTFGSGTQLTVLPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 585 - protein, 277 aa, Homo sapiens
  TCR 23 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMSPPGGSARQLTFGSGTQLTVLPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 586 - protein, 277 aa, Homo sapiens
  TCR 23 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMSPPGGSARQLTFGSGTQLTVLPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 587 - protein, 116 aa, Homo sapiens
  TCR 23 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMSPPGGSARQLTFGSGTQLTVLP

SEQ ID NO: 588 - protein, 13 aa, Homo sapiens
  TCR 23 Alpha CDR3
AMSPPGGSARQLT

SEQ ID NO: 589 - protein, 291 aa, Homo sapiens
  TCR 23 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSPWGQSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 590 - protein, 291 aa, Homo sapiens
  TCR 23 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSPWGQSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 591 - protein, 310 aa, Homo sapiens
  TCR 23 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGQSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 592 - protein, 310 aa, Homo sapiens
  TCR 23 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPWGQSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 593 - protein, 114 aa, Homo sapiens
  TCR 23 Beta variable region
DVKVTQSSRYLVKRTGEKVFLECVQDMDHENMFWYRQDPGLGLRLIYFSYDVKMKEKGDIPEGYSVSREKKERFSLILESASTNQTSMYLCASSPWGQSNQPQHFGDGTRLSIL

SEQ ID NO: 594 - protein, 13 aa, Homo sapiens
  TCR 23 Beta CDR3
ASSPWGQSNQPQH

SEQ ID NO: 595 - protein, 258 aa, Homo sapiens
  TCR 24 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGDSWGKLQFGAGTQVVVTPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 596 - protein, 258 aa, Homo sapiens
  TCR 24 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGDSWGKLQFGAGTQVVVTPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 597 - protein, 278 aa, Homo sapiens
  TCR 24 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGDSWGKLQFGAGTQVVVTPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 598 - protein, 278 aa, Homo sapiens
  TCR 24 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGDSWGKLQFGAGTQVVVTPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 599 - protein, 117 aa, Homo sapiens
  TCR 24 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGRGDSWGKLQFGAGTQVVVTP

SEQ ID NO: 600 - protein, 14 aa, Homo sapiens
  TCR 24 Alpha CDR3
AMREGRGDSWGKLQ

SEQ ID NO: 601 - protein, 293 aa, Homo sapiens
  TCR 24 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSPFGRGSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 602 - protein, 293 aa, Homo sapiens
  TCR 24 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSPFGRGSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 603 - protein, 312 aa, Homo sapiens
  TCR 24 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPFGRGSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 604 - protein, 312 aa, Homo sapiens
  TCR 24 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSPFGRGSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 605 - protein, 114 aa, Homo sapiens
  TCR 24 Beta variable region
DVKVTQSSRYLVKRTGEKVFLECVQDMDHENMFWYRQDPGLGLRLIYFSYDVKMKEKGDIPEGYSVSREKKERFSLILESASTNQTSMYLCASSPFGRGSYEQYFGPGTRLTVT

SEQ ID NO: 606 - protein, 13 aa, Homo sapiens
  TCR 24 Beta CDR3
ASSPFGRGSYEQY

SEQ ID NO: 607 - protein, 259 aa, Homo sapiens
  TCR 25 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGSLTGGGNKLTFGTGTQLKVELNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 608 - protein, 259 aa, Homo sapiens
  TCR 25 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGSLTGGGNKLTFGTGTQLKVELNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 609 - protein, 259 aa, Homo sapiens; identical to SEQ ID NO: 608
  TCR 25 - Alpha Cysteine-modified

SEQ ID NO: 610 - protein, 279 aa, Homo sapiens
  TCR 25 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMREGSLTGGGNKLTFGTGTQLKVELNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 611 - protein, 118 aa, Homo sapiens
  TCR 25 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMREGSLTGGGNKLTFGTGTQLKVEL

SEQ ID NO: 612 - protein, 15 aa, Homo sapiens
  TCR 25 Alpha CDR3
AMREGSLTGGGNKLT

SEQ ID NO: 613 - protein, 291 aa, Homo sapiens
  TCR 25 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGQSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 614 - protein, 291 aa, Homo sapiens
  TCR 25 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGQSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 615 - protein, 310 aa, Homo sapiens
  TCR 25 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGQSNQPQHFGDGTRLSILEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 616 - protein, 310 aa, Homo sapiens
  TCR 25 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGQSNQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 617 - protein, 114 aa, Homo sapiens
  TCR 25 Beta variable region
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGQSNQPQHFGDGTRLSIL

SEQ ID NO: 618 - protein, 13 aa, Homo sapiens
  TCR 25 Beta CDR3
ASSLWGQSNQPQH

SEQ ID NO: 619 - protein, 255 aa, Homo sapiens
  TCR 26 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRDARNNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 620 - protein, 255 aa, Homo sapiens
  TCR 26 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRDARNNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 621 - protein, 275 aa, Homo sapiens
  TCR 26 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRDARNNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 622 - protein, 275 aa, Homo sapiens
  TCR 26 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRDARNNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 623 - protein, 114 aa, Homo sapiens
  TCR 26 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRDARNNDMRFGAGTRLTVKP

SEQ ID NO: 624 - protein, 11 aa, Homo sapiens
  TCR 26 Alpha CDR3
AMRDARNNDMR

SEQ ID NO: 625 - protein, 294 aa, Homo sapiens
  TCR 26 - Beta Native
NAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYYASGRNYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 626 - protein, 294 aa, Homo sapiens
  TCR 26 - Beta Cysteine-modified
NAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYYASGRNYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 627 - protein, 313 aa, Homo sapiens
  TCR 26 - Beta Native
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYYASGRNYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 628 - protein, 313 aa, Homo sapiens
  TCR 26 - Beta Cysteine-modified
MSLGLLCCGAFSLLWAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYYASGRNYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 629 - protein, 114 aa, Homo sapiens
  TCR 26 Beta variable region
NAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYYASGRNYEQYFGPGTRLTV

SEQ ID NO: 630 - protein, 14 aa, Homo sapiens
  TCR 26 Beta CDR3
ASSYYASGRNYEQY

SEQ ID NO: 631 - protein, 180 aa, Homo sapiens
  TCR 26 - Native TCR beta constant region
TEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 632 - protein, 180 aa, Homo sapiens
  TCR 26 -  TCR beta constant region
TEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 633 - protein, 255 aa, Homo sapiens
  TCR 27 - Alpha Native
DAKTTQPNSMESNEEEPVHLPCNHSTISGTDYIHWYRQLPSQGPEYVIHGLTSNVNNRMASLAIAEDRKSSTLILHRATLRDAAVYYCILRVPPQSGGYQKVTFGTGTKLQVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 634 - protein, 255 aa, Homo sapiens
  TCR 27 - Alpha Cysteine-modified
DAKTTQPNSMESNEEEPVHLPCNHSTISGTDYIHWYRQLPSQGPEYVIHGLTSNVNNRMASLAIAEDRKSSTLILHRATLRDAAVYYCILRVPPQSGGYQKVTFGTGTKLQVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 635 - protein, 272 aa, Homo sapiens
  TCR 27 - Alpha Native
MKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILRVPPQSGGYQKVTFGTGTKLQVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 636 - protein, 272 aa, Homo sapiens
  TCR 27 - Alpha Cysteine-modified
MKLVTSITVLLSLGIMGDAKTTQPNSMESNEEEPVHLPCNHSTISGTDYIHWYRQLPSQGPEYVIHGLTSNVNNRMASLAIAEDRKSSTLILHRATLRDAAVYYCILRVPPQSGGYQKVTFGTGTKLQVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 637 - protein, 114 aa, Homo sapiens
  TCR 27 Alpha variable region
DAKTTQPNSMESNEEEPVHLPCNHSTISGTDYIHWYRQLPSQGPEYVIHGLTSNVNNRMASLAIAEDRKSSTLILHRATLRDAAVYYCILRVPPQSGGYQKVTFGTGTKLQVIP

SEQ ID NO: 638 - protein, 15 aa, Homo sapiens
  TCR 27 Alpha CDR3
ILRVPPQSGGYQKVT

SEQ ID NO: 639 - protein, 291 aa, Homo sapiens
  TCR 27 - Beta Native
NAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEFGSLNEKLFFGSGTQLSVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 640 - protein, 291 aa, Homo sapiens
  TCR 27 - Beta Cysteine-modified
NAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEFGSLNEKLFFGSGTQLSVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 641 - protein, 324 aa, Homo sapiens
  TCR 27 - Beta Native
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEFGSLNEKLFFGSGTQLSVLEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 642 - protein, 324 aa, Homo sapiens
  TCR 27 - Beta Cysteine-modified
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEFGSLNEKLFFGSGTQLSVLEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 643 - protein, 114 aa, Homo sapiens
  TCR 27 Beta variable region
NAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEFGSLNEKLFFGSGTQLSVL

SEQ ID NO: 644 - protein, 13 aa, Homo sapiens
  TCR 27 Beta CDR3
ASSEFGSLNEKLF

SEQ ID NO: 645 - protein, 253 aa, Homo sapiens
  TCR 28 - Alpha Native
RKEVEQDPGPFNVPEGATVAFNCTYSNSASQSFFWYRQDCRKEPKLLMSVYSSGNEDGRFTAQLNRASQYISLLIRDSKLSDSATYLCVVRGGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 646 - protein, 253 aa, Homo sapiens
  TCR 28 - Alpha Cysteine-modified
RKEVEQDPGPFNVPEGATVAFNCTYSNSASQSFFWYRQDCRKEPKLLMSVYSSGNEDGRFTAQLNRASQYISLLIRDSKLSDSATYLCVVRGGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 647 - protein, 275 aa, Homo sapiens
  TCR 28 - Alpha Native
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVRGGGTSYGKLTFGQGTILTVHPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 648 - protein, 275 aa, Homo sapiens
  TCR 28 - Alpha Cysteine-modified
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVRGGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 649 - protein, 112 aa, Homo sapiens
  TCR 28 Alpha variable region
RKEVEQDPGPFNVPEGATVAFNCTYSNSASQSFFWYRQDCRKEPKLLMSVYSSGNEDGRFTAQLNRASQYISLLIRDSKLSDSATYLCVVRGGGTSYGKLTFGQGTILTVHP

SEQ ID NO: 650 - protein, 13 aa, Homo sapiens
  TCR 28 Alpha CDR3
VVRGGGTSYGKLT

SEQ ID NO: 651 - protein, 292 aa, Homo sapiens
  TCR 28 - Beta Native
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSSGNTIYFGEGSWLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 652 - protein, 292 aa, Homo sapiens
  TCR 28 - Beta Cysteine-modified
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSSGNTIYFGEGSWLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 653 - protein, 311 aa, Homo sapiens
  TCR 28 - Beta Native
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSSGNTIYFGEGSWLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 654 - protein, 311 aa, Homo sapiens
  TCR 28 - Beta Cysteine-modified
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSSGNTIYFGEGSWLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 655 - protein, 115 aa, Homo sapiens
  TCR 28 Beta variable region
DVKVTQSSRYLVKRTGEKVFLECVQDMDHENMFWYRQDPGLGLRLIYFSYDVKMKEKGDIPEGYSVSREKKERFSLILESASTNQTSMYLCASSLWGRSSGNTIYFGEGSWLTVV

SEQ ID NO: 656 - protein, 14 aa, Homo sapiens
  TCR 28 Beta CDR3
ASSLWGRSSGNTIY

SEQ ID NO: 657 - protein, 257 aa, Homo sapiens
  TCR 29 - Alpha Native
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRLNTGTASKLTFGTGTRLQVTLDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 658 - protein, 257 aa, Homo sapiens
  TCR 29 - Alpha Cysteine-modified
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRLNTGTASKLTFGTGTRLQVTLDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 659 - protein, 277 aa, Homo sapiens
  TCR 29 - Alpha Native
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRLNTGTASKLTFGTGTRLQVTLDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 660 - protein, 277 aa, Homo sapiens
  TCR 29 - Alpha Cysteine-modified
MSLSSLLKVVTASLWLGPGIAQKITQTQPGMFVQEKEAVTLDCTYDTSDQSYGLFWYKQPSSGEMIFLIYQGSYDEQNATEGRYSLNFQKARKSANLVISASQLGDSAMYFCAMRLNTGTASKLTFGTGTRLQVTLDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 661 - protein, 116 aa, Homo sapiens
  TCR 29 Alpha variable region
AQKITQTQPGMFVQEKEAVTLDCTYDTSDQSYGLFWYKQPSSGEMIFLIYQGSYDEQNATEGRYSLNFQKARKSANLVISASQLGDSAMYFCAMRLNTGTASKLTFGTGTRLQVTL

SEQ ID NO: 662 - protein, 13 aa, Homo sapiens
  TCR 29 Alpha CDR3
AMRLNTGTASKLT

SEQ ID NO: 663 - protein, 293 aa, Homo sapiens
  TCR 29 - Beta Native
DGGITQSPKYLFRKEGQNVTLSCEQNLNHDAMYWYRQDPGQGLRLIYYSQIVNDFQKGDIAEGYSVSREKKESFPLTVTSAQKNPTAFYLCASSPWGRATNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 664 - protein, 293 aa, Homo sapiens
  TCR 29 - Beta Cysteine-modified
DGGITQSPKYLFRKEGQNVTLSCEQNLNHDAMYWYRQDPGQGLRLIYYSQIVNDFQKGDIAEGYSVSREKKESFPLTVTSAQKNPTAFYLCASSPWGRATNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 665 - protein, 312 aa, Homo sapiens
  TCR 29 - Beta Native
MSNQVLCCVVLCLLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSPWGRATNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 666 - protein, 312 aa, Homo sapiens
  TCR 29 - Beta Cysteine-modified
MSNQVLCCVVLCLLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSPWGRATNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 667 - protein, 114 aa, Homo sapiens
  TCR 29 Beta variable region
DGGITQSPKYLFRKEGQNVTLSCEQNLNHDAMYWYRQDPGQGLRLIYYSQIVNDFQKGDIAEGYSVSREKKESFPLTVTSAQKNPTAFYLCASSPWGRATNEQFFGPGTRLTVL

SEQ ID NO: 668 - protein, 5 aa, Homo sapiens
  TCR 29 Beta CDR1
LNHDA

SEQ ID NO: 669 - protein, 6 aa, Homo sapiens
  TCR 29 Beta CDR2
SQIVND

SEQ ID NO: 670 - protein, 13 aa, Homo sapiens
  TCR 29 Beta CDR3
ASSPWGRATNEQF

SEQ ID NO: 671 - protein, 19 aa, Homo sapiens
  TCR 29 Beta signal peptide
MSNQVLCCVVLCLLGANTV

SEQ ID NO: 672 - protein, 255 aa, Homo sapiens
  TCR 30 - Alpha Native
DAKTTQPPSMDCAEGRAANLPCNHSTISGNEYVYWYRQIHSQGPQYIIHGLKNNETNEMASLIITEDRKSSTLILPHATLRDTAVYYCIVRGTSVLQGNEKLTFGTGTRLTIIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 673 - protein, 255 aa, Homo sapiens
  TCR 30 - Alpha Cysteine-modified
DAKTTQPPSMDCAEGRAANLPCNHSTISGNEYVYWYRQIHSQGPQYIIHGLKNNETNEMASLIITEDRKSSTLILPHATLRDTAVYYCIVRGTSVLQGNEKLTFGTGTRLTIIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 674 - protein, 272 aa, Homo sapiens
  TCR 30 - Alpha Native
MRLVARVTVFLTFGTIIDAKTTQPPSMDCAEGRAANLPCNHSTISGNEYVYWYRQIHSQGPQYIIHGLKNNETNEMASLIITEDRKSSTLILPHATLRDTAVYYCIVRGTSVLQGNEKLTFGTGTRLTIIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 675 - protein, 272 aa, Homo sapiens
  TCR 30 - Alpha Cysteine-modified
MRLVARVTVFLTFGTIIDAKTTQPPSMDCAEGRAANLPCNHSTISGNEYVYWYRQIHSQGPQYIIHGLKNNETNEMASLIITEDRKSSTLILPHATLRDTAVYYCIVRGTSVLQGNEKLTFGTGTRLTIIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 676 - protein, 114 aa, Homo sapiens
  TCR 30 Alpha variable region
DAKTTQPPSMDCAEGRAANLPCNHSTISGNEYVYWYRQIHSQGPQYIIHGLKNNETNEMASLIITEDRKSSTLILPHATLRDTAVYYCIVRGTSVLQGNEKLTFGTGTRLTIIP

SEQ ID NO: 677 - protein, 7 aa, Homo sapiens
  TCR 30 Alpha CDR1
TISGNEY

SEQ ID NO: 678 - protein, 5 aa, Homo sapiens
  TCR 30 Alpha CDR2
GLKNN

SEQ ID NO: 679 - protein, 15 aa, Homo sapiens
  TCR 30 Alpha CDR3
IVRGTSVLQGNEKLT

SEQ ID NO: 680 - protein, 17 aa, Homo sapiens
  TCR 30 Alpha signal peptide
MRLVARVTVFLTFGTII

SEQ ID NO: 681 - protein, 292 aa, Homo sapiens
  TCR 30 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASSRQPSSGNTIYFGEGSWLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 682 - protein, 292 aa, Homo sapiens
  TCR 30 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASSRQPSSGNTIYFGEGSWLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 683 - protein, 311 aa, Homo sapiens
  TCR 30 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASSRQPSSGNTIYFGEGSWLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 684 - protein, 311 aa, Homo sapiens
  TCR 30 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASSRQPSSGNTIYFGEGSWLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 685 - protein, 115 aa, Homo sapiens
  TCR 30 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASSRQPSSGNTIYFGEGSWLTVV

SEQ ID NO: 686 - protein, 13 aa, Homo sapiens
  TCR 30 Beta CDR3
ASSRQPSSGNTIY

SEQ ID NO: 687 - protein, 253 aa, Homo sapiens
  TCR 31 - Alpha Native
DQQVKQNSPSLSVQEGRISILNCDYTNSMFDYFLWYKKYPAEGPTFLISISSIKDKNEDGRFTVFLNKSAKHLSLHIVPSQPGDSAVYFCAASERGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 688 - protein, 253 aa, Homo sapiens
  TCR 31 - Alpha Cysteine-modified
DQQVKQNSPSLSVQEGRISILNCDYTNSMFDYFLWYKKYPAEGPTFLISISSIKDKNEDGRFTVFLNKSAKHLSLHIVPSQPGDSAVYFCAASERGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 689 - protein, 279 aa, Homo sapiens
  TCR 31 - Alpha Native
MAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAASERGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 690 - protein, 279 aa, Homo sapiens
  TCR 31 - Alpha Cysteine-modified
MAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAASERGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 691 - protein, 112 aa, Homo sapiens
  TCR 31 Alpha variable region
DQQVKQNSPSLSVQEGRISILNCDYTNSMFDYFLWYKKYPAEGPTFLISISSIKDKNEDGRFTVFLNKSAKHLSLHIVPSQPGDSAVYFCAASERGTYKYIFGTGTRLKVLA

SEQ ID NO: 692 - protein, 6 aa, Homo sapiens
  TCR 31 Alpha CDR1
NSMFDY

SEQ ID NO: 693 - protein, 7 aa, Homo sapiens
  TCR 31 Alpha CDR2
ISSIKDK

SEQ ID NO: 694 - protein, 11 aa, Homo sapiens
  TCR 31 Alpha CDR3
AASERGTYKYI

SEQ ID NO: 695 - protein, 26 aa, Homo sapiens
  TCR 31 Alpha signal peptide
MAMLLGASVLILWLQPDWVNSQQKND

SEQ ID NO: 696 - protein, 294 aa, Homo sapiens
  TCR 31 - Beta Native
GAGVSQSPSNKVTEKGKDVELRCDPISGHTALYWYRQSLGQGLEFLIYFQGNSAPDKSGLPSDRFSAERTGGSVSTLTIQRTQQEDSAVYLCASSRFLGSTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 697 - protein, 294 aa, Homo sapiens
  TCR 31 - Beta Cysteine-modified
GAGVSQSPSNKVTEKGKDVELRCDPISGHTALYWYRQSLGQGLEFLIYFQGNSAPDKSGLPSDRFSAERTGGSVSTLTIQRTQQEDSAVYLCASSRFLGSTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 698 - protein, 313 aa, Homo sapiens
  TCR 31 - Beta Native
MGTRLLFWVAFCLLGADHTGAGVSQSPSNKVTEKGKDVELRCDPISGHTALYWYRQSLGQGLEFLIYFQGNSAPDKSGLPSDRFSAERTGGSVSTLTIQRTQQEDSAVYLCASSRFLGSTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 699 - protein, 313 aa, Homo sapiens
  TCR 31 - Beta Cysteine-modified
MGTRLLFWVAFCLLGADHTGAGVSQSPSNKVTEKGKDVELRCDPISGHTALYWYRQSLGQGLEFLIYFQGNSAPDKSGLPSDRFSAERTGGSVSTLTIQRTQQEDSAVYLCASSRFLGSTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 700 - protein, 115 aa, Homo sapiens
  TCR 31 Beta variable region
GAGVSQSPSNKVTEKGKDVELRCDPISGHTALYWYRQSLGQGLEFLIYFQGNSAPDKSGLPSDRFSAERTGGSVSTLTIQRTQQEDSAVYLCASSRFLGSTDTQYFGPGTRLTVL

SEQ ID NO: 701 - protein, 5 aa, Homo sapiens
  TCR 31/ TCR 45/ TCR 46 Beta CDR1
SGHTA

SEQ ID NO: 702 - protein, 6 aa, Homo sapiens
  TCR 31/ TCR 45 Beta CDR2
FQGNSA

SEQ ID NO: 703 - protein, 13 aa, Homo sapiens
  TCR 31 Beta CDR3
ASSRFLGSTDTQY

SEQ ID NO: 704 - protein, 19 aa, Homo sapiens
  TCR 31/ TCR 32 Beta signal peptide
MGTRLLFWVAFCLLGADHT

SEQ ID NO: 705 - protein, 250 aa, Homo sapiens
  TCR 32 - Alpha Native
TQLLEQSPQFLSIQEGENLTVYCNSSSVFSSLQWYRQEPGEGPVLLVTVVTGGEVKKLKRLTFQFGDARKDSSLHITAAQPGDTGLYLCAGGSNYKLTFGKGTLLTVNPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 706 - protein, 250 aa, Homo sapiens
  TCR 32 - Alpha Cysteine-modified
TQLLEQSPQFLSIQEGENLTVYCNSSSVFSSLQWYRQEPGEGPVLLVTVVTGGEVKKLKRLTFQFGDARKDSSLHITAAQPGDTGLYLCAGGSNYKLTFGKGTLLTVNPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 707 - protein, 268 aa, Homo sapiens
  TCR 32 - Alpha Native
MVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGGSNYKLTFGKGTLLTVNPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 708 - protein, 268 aa, Homo sapiens
  TCR 32 - Alpha Cysteine-modified
MVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGGSNYKLTFGKGTLLTVNPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 709 - protein, 109 aa, Homo sapiens
  TCR 32 Alpha variable region
TQLLEQSPQFLSIQEGENLTVYCNSSSVFSSLQWYRQEPGEGPVLLVTVVTGGEVKKLKRLTFQFGDARKDSSLHITAAQPGDTGLYLCAGGSNYKLTFGKGTLLTVNP

SEQ ID NO: 710 - protein, 5 aa, Homo sapiens
  TCR 32/ TCR 52 Alpha CDR1
SVFSS

SEQ ID NO: 711 - protein, 7 aa, Homo sapiens
  TCR 32/ TCR 52 Alpha CDR2
VVTGGEV

SEQ ID NO: 712 - protein, 9 aa, Homo sapiens
  TCR 32 Alpha CDR3
AGGSNYKLT

SEQ ID NO: 713 - protein, 18 aa, Homo sapiens
  TCR 32/ TCR 52 Alpha signal peptide
MVLKFSVSILWIQLAWVS

SEQ ID NO: 714 - protein, 293 aa, Homo sapiens
  TCR 32 - Beta Native
DSGVTQTPKHLITATGQRVTLRCSPRSGDLSVYWYQQSLDQGLQFLIQYYNGEERAKGNILERFSAQQFPDLHSELNLSSLELGDSALYFCASSVGGDHSDEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 715 - protein, 293 aa, Homo sapiens
  TCR 32 - Beta Cysteine-modified
DSGVTQTPKHLITATGQRVTLRCSPRSGDLSVYWYQQSLDQGLQFLIQYYNGEERAKGNILERFSAQQFPDLHSELNLSSLELGDSALYFCASSVGGDHSDEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 716 - protein, 312 aa, Homo sapiens
  TCR 32 - Beta Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGGDHSDEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 717 - protein, 312 aa, Homo sapiens
  TCR 32 - Beta Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGGDHSDEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 718 - protein, 114 aa, Homoe sapiens
  TCR 32 Beta variable region
DSGVTQTPKHLITATGQRVTLRCSPRSGDLSVYWYQQSLDQGLQFLIQYYNGEERAKGNILERFSAQQFPDLHSELNLSSLELGDSALYFCASSVGGDHSDEQFFGPGTRLTVL

SEQ ID NO: 719 - protein, 5 aa, Homo sapiens
  TCR 32/ TCR 35/ TCR 44/ TCR 50/ TCR 52 Beta CDR1
SGDLS

SEQ ID NO: 720 - protein, 6 aa, Homo sapiens
  TCR 32/ TCR 35/ TCR 44/ TCR 50/ TCR 52  Beta CDR2
YYNGEE

SEQ ID NO: 721 - protein, 13 aa, Homo sapiens
  TCR 32 Beta CDR3
ASSVGGDHSDEQF

SEQ ID NO: 722 - protein, 254 aa, Homo sapiens
  TCR 33 - Alpha Native
QKEVEQNSGPLSVPEGAIASLNCTYSDRGSQSFFWYRQYSGKSPELIMFIYSNGDKEDGRFTAQLNKASQYVSLLIRDSQPSDSATYLCAVNAHHTGGFKTIFGAGTRLFVKANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 723 - protein, 254 aa, Homo sapiens
  TCR 33 - Alpha Cysteine-modified
QKEVEQNSGPLSVPEGAIASLNCTYSDRGSQSFFWYRQYSGKSPELIMFIYSNGDKEDGRFTAQLNKASQYVSLLIRDSQPSDSATYLCAVNAHHTGGFKTIFGAGTRLFVKANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 724 - protein, 276 aa, Homo sapiens
  TCR 33 - Alpha Native
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNAHHTGGFKTIFGAGTRLFVKANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 725 - protein, 276 aa, Homo sapiens
  TCR 33 - Alpha Cysteine-modified
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNAHHTGGFKTIFGAGTRLFVKANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 726 - protein, 113 aa, Homo sapiens
  TCR 33 Alpha variable region
QKEVEQNSGPLSVPEGAIASLNCTYSDRGSQSFFWYRQYSGKSPELIMFIYSNGDKEDGRFTAQLNKASQYVSLLIRDSQPSDSATYLCAVNAHHTGGFKTIFGAGTRLFVKA

SEQ ID NO: 727 - protein, 6 aa, Homo sapiens
  TCR 33/ TCR 43/ TCR 47/ TCR 49/ TCR 51 Alpha CDR1
DRGSQS

SEQ ID NO: 728 - protein, 6 aa, Homo sapiens
  TCR 33/ TCR 43/ TCR 47/ TCR 49/ TCR 51 Alpha CDR2
IYSNGD

SEQ ID NO: 729 - protein, 13 aa, Homo sapiens
  TCR 33 Alpha CDR3
AVNAHHTGGFKTI

SEQ ID NO: 730 - protein, 22 aa, Homo sapiens
  TCR 33/ TCR 43/ TCR 47/ TCR 48/ TCR 49/ TCR 51 Alpha signal peptide
MMKSLRVLLVILWLQLSWVWSQ

SEQ ID NO: 731 - protein, 292 aa, Homo sapiens
  TCR 33 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDTYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 732 - protein, 292 aa, Homo sapiens
  TCR 33 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDTYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 733 - protein, 311 aa, Homo sapiens
  TCR 33 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDTYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 734 - protein, 311 aa, Homo sapiens
  TCR 33 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDTYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 735 - protein, 113 aa, Homo sapiens
  TCR 33 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDTYEQYFGPGTRLTVT

SEQ ID NO: 736 - protein, 11 aa, Homo sapiens
  TCR 33 Beta CDR3
ASTPRDTYEQY

SEQ ID NO: 737 - protein, 250 aa, Homo sapiens
  TCR 34 - Alpha Native
ELKVEQNPLFLSMQEGKNYTIYCNYSTTSDRLYWYRQDPGKSLESLFVLLSNGAVKQEGRLMASLDTKARLSTLHITAAVHDLSATYFCAVSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 738 - protein, 250 aa, Homo sapiens
  TCR 34 - Alpha Cysteine-modified
ELKVEQNPLFLSMQEGKNYTIYCNYSTTSDRLYWYRQDPGKSLESLFVLLSNGAVKQEGRLMASLDTKARLSTLHITAAVHDLSATYFCAVSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 739 - protein, 268 aa, Homo sapiens
  TCR 34 - Alpha Native
MKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAVSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 740 - protein, 268 aa, Homo sapiens
  TCR 34 - Alpha Cysteine-modified
MKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAVSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 741 - protein, 109 aa, Homo sapiens
  TCR 34 Alpha variable region
ELKVEQNPLFLSMQEGKNYTIYCNYSTTSDRLYWYRQDPGKSLESLFVLLSNGAVKQEGRLMASLDTKARLSTLHITAAVHDLSATYFCAVSGTYKYIFGTGTRLKVLA

SEQ ID NO: 742 - protein, 5 aa, Homo sapiens
  TCR 34/ TCR 37 Alpha CDR1
TTSDR

SEQ ID NO: 743 - protein, 7 aa, Homo sapiens
  TCR 34/ TCR 37 Alpha CDR2
LLSNGAV

SEQ ID NO: 744 - protein, 9 aa, Homo sapiens
  TCR 34  Alpha CDR3
AVSGTYKYI

SEQ ID NO: 745 - protein, 18 aa, Homo sapiens
  TCR 34/ TCR 37 Alpha signal peptide
MKKLLAMILWLQLDRLSG

SEQ ID NO: 746 - protein, 292 aa, Homo sapiens
  TCR 34 - Beta Native
ETGVTQSPTHLIKTRGQQVTLRCSSQSGHNTVSWYQQALGQGPQFIFQYYREEENGRGNFPPRFSGLQFPNYSSELNVNALELDDSALYLCASSSYAGSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 747 - protein, 292 aa, Homo sapiens
  TCR 34 - Beta Cysteine-modified
ETGVTQSPTHLIKTRGQQVTLRCSSQSGHNTVSWYQQALGQGPQFIFQYYREEENGRGNFPPRFSGLQFPNYSSELNVNALELDDSALYLCASSSYAGSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 748 - protein, 311 aa, Homo sapiens
  TCR 34 - Beta Native
MGPGLLCWALLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSSYAGSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 749 - protein, 311 aa, Homo sapiens
  TCR 34 - Beta Cysteine-modified
MGPGLLCWALLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSSYAGSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 750 - protein, 113 aa, Homo sapiens
  TCR 34 Beta variable region
ETGVTQSPTHLIKTRGQQVTLRCSSQSGHNTVSWYQQALGQGPQFIFQYYREEENGRGNFPPRFSGLQFPNYSSELNVNALELDDSALYLCASSSYAGSYEQYFGPGTRLTVT

SEQ ID NO: 751 - protein, 5 aa, Homo sapiens
  TCR 34/ TCR 38 Beta CDR1
SGHNT

SEQ ID NO: 752 - protein, 6 aa, Homo sapiens
  TCR 34/ TCR 38 Beta CDR2
YYREEE

SEQ ID NO: 753 - protein, 13 aa, Homo sapiens
  TCR 34 Beta CDR3
ASSSYAGSYEQYF

SEQ ID NO: 754 - protein, 19 aa, Homo sapiens
  TCR 34 Beta signal peptide
MGPGLLCWALLCLLGAGSV

SEQ ID NO: 755 - protein, 245 aa, Homo sapiens
  TCR 35 - Alpha Native
KDQVFQPSTVASSEGAVVEIFCNHSVSNAYNFFWYLHFPGCAPRLLVKGSKPSQQGRYNMTYERFSSSLLILQVREADAAVYYCAVAGDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 756 - protein, 245 aa, Homo sapiens
  TCR 35 - Alpha Cysteine-modified
KDQVFQPSTVASSEGAVVEIFCNHSVSNAYNFFWYLHFPGCAPRLLVKGSKPSQQGRYNMTYERFSSSLLILQVREADAAVYYCAVAGDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 757 - protein, 270 aa, Homo sapiens
  TCR 35 - Alpha Native
MALQSTLGAVWLGLLLNSLWKVAESKDQVFQPSTVASSEGAVVEIFCNHSVSNAYNFFWYLHFPGCAPRLLVKGSKPSQQGRYNMTYERFSSSLLILQVREADAAVYYCAVAGDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 758 - protein, 270 aa, Homo sapiens
  TCR 35 - Alpha Cysteine-modified
MALQSTLGAVWLGLLLNSLWKVAESKDQVFQPSTVASSEGAVVEIFCNHSVSNAYNFFWYLHFPGCAPRLLVKGSKPSQQGRYNMTYERFSSSLLILQVREADAAVYYCAVAGDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 759 - protein, 104 aa, Homo sapiens
  TCR 35 Alpha variable region
KDQVFQPSTVASSEGAVVEIFCNHSVSNAYNFFWYLHFPGCAPRLLVKGSKPSQQGRYNMTYERFSSSLLILQVREADAAVYYCAVAGDYKLSFGAGTTVTVRA

SEQ ID NO: 760 - protein, 6 aa, Homo sapiens
  TCR 35 Alpha CDR1
VSNAYN

SEQ ID NO: 761 - protein, 4 aa, Homo sapiens
  TCR 35 Alpha CDR2
GSKP

SEQ ID NO: 762 - protein, 9 aa, Homo sapiens
  TCR 35 Alpha CDR3
AVAGDYKLS

SEQ ID NO: 763 - protein, 25 aa, Homo sapiens
  TCR 35 Alpha signal peptide
MALQSTLGAVWLGLLLNSLWKVAES

SEQ ID NO: 764 - protein, 294 aa, Homo sapiens
  TCR 35 - Beta Native
DSGVTQTPKHLITATGQRVTLRCSPRSGDLSVYWYQQSLDQGLQFLIQYYNGEERAKGNILERFSAQQFPDLHSELNLSSLELGDSALYFCASTTSGDSSYNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 765 - protein, 294 aa, Homo sapiens
  TCR 35 - Beta Cysteine-modified
DSGVTQTPKHLITATGQRVTLRCSPRSGDLSVYWYQQSLDQGLQFLIQYYNGEERAKGNILERFSAQQFPDLHSELNLSSLELGDSALYFCASTTSGDSSYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 766 - protein, 313 aa, Homo sapiens
  TCR 35 - Beta Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASTTSGDSSYNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 767 - protein, 313 aa, Homo sapiens
  TCR 35 - Beta Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASTTSGDSSYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 768 - protein, 115 aa, Homo sapiens
  TCR 35 Beta variable region
DSGVTQTPKHLITATGQRVTLRCSPRSGDLSVYWYQQSLDQGLQFLIQYYNGEERAKGNILERFSAQQFPDLHSELNLSSLELGDSALYFCASTTSGDSSYNEQFFGPGTRLTVL

SEQ ID NO: 769 - protein, 14 aa, Homo sapiens
  TCR 35 Beta CDR3
ASTTSGDSSYNEQF

SEQ ID NO: 770 - protein, 19 aa, Homo sapiens
  TCR 35/ TCR 44/ TCR 50/ TCR 52 Beta signal peptide
MGFRLLCCVAFCLLGAGPV

SEQ ID NO: 771 - protein, 252 aa, Homo sapiens
  TCR 36 - Alpha Native
RKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 772 - protein, 252 aa, Homo sapiens
  TCR 36 - Alpha Cysteine-modified
RKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 773 - protein, 274 aa, Homo sapiens
  TCR 36 - Alpha Native
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPYIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 774 - protein, 274 aa, Homo sapiens
  TCR 36 - Alpha Cysteine-modified
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 775 - protein, 111 aa, Homo sapiens
  TCR 36 Alpha variable region
RKEVEQDPGPFNVPEGATVAFNCTYSNSASQSFFWYRQDCRKEPKLLMSVYSSGNEDGRFTAQLNRASQYISLLIRDSKLSDSATYLCVVNRDNYGQNFVFGPGTRLSVLP

SEQ ID NO: 776 - protein, 12 aa, Homo sapiens
  TCR 36 Alpha CDR3
VVNRDNYGQNFV

SEQ ID NO: 777 - protein, 292 aa, Homo sapiens
  TCR 36 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRSNYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 778 - protein, 292 aa, Homo sapiens
  TCR 36 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRSNYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 779 - protein, 311 aa, Homo sapiens
  TCR 36 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRSNYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 780 - protein, 311 aa, Homo sapiens
  TCR 36 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRSNYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 781 - protein, 113 aa, Homo sapiens
  TCR 36 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRSNYEQYFGPGTRLTVT

SEQ ID NO: 782 - protein, 11 aa, Homo sapiens
  TCR 36 Beta CDR3
AMTGRSNYEQY

SEQ ID NO: 783 - protein, 253 aa, Homo sapiens
  TCR 37 - Alpha Native
ELKVEQNPLFLSMQEGKNYTIYCNYSTTSDRLYWYRQDPGKSLESLFVLLSNGAVKQEGRLMASLDTKARLSTLHITAAVHDLSATYFCAGYSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 784 - protein, 253 aa, Homo sapiens
  TCR 37 - Alpha Cysteine-modified
ELKVEQNPLFLSMQEGKNYTIYCNYSTTSDRLYWYRQDPGKSLESLFVLLSNGAVKQEGRLMASLDTKARLSTLHITAAVHDLSATYFCAGYSGAGSYQLTFGKGTKLSVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 785 - protein, 271 aa, Homo sapiens
  TCR 37 - Alpha Native
MKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAGYSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 786 - protein, 271 aa, Homo sapiens
  TCR 37 - Alpha Cysteine-modified
MKKLLAMILWLQLDRLSGELKVEQNPLFLSMQEGKNYTIYCNYSTTSDRLYWYRQDPGKSLESLFVLLSNGAVKQEGRLMASLDTKARLSTLHITAAVHDLSATYFCAGYSGAGSYQLTFGKGTKLSVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 787 - protein, 112 aa, Homo sapiens
  TCR 37 Alpha variable region
ELKVEQNPLFLSMQEGKNYTIYCNYSTTSDRLYWYRQDPGKSLESLFVLLSNGAVKQEGRLMASLDTKARLSTLHITAAVHDLSATYFCAGYSGAGSYQLTFGKGTKLSVIP

SEQ ID NO: 788 - protein, 12 aa, Homo sapiens
  TCR 37 Alpha CDR3
AGYSGAGSYQLT

SEQ ID NO: 789 - protein, 291 aa, Homo sapiens
  TCR 37 - Beta Native
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSLLLGAYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 790 - protein, 291 aa, Homo sapiens
  TCR 37 - Beta Cysteine-modified
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSLLLGAYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 791 - protein, 310 aa, Homo sapiens
  TCR 37 - Beta Native
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSLLLGAYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 792 - protein, 310 aa, Homo sapiens
  TCR 37 - Beta Cysteine-modified
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSLLLGAYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 793 - protein, 114 aa, Homo sapiens
  TCR 37 Beta variable region
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSLLLGAYGYTFGSGTRLTVV

SEQ ID NO: 794 - protein, 12 aa, Homo sapiens
  TCR 37 Beta CDR3
ASSLLLGAYGYT

SEQ ID NO: 795 - protein, 247 aa, Homo sapiens
  TCR 38 - Alpha Native
GIQVEQSPPDLILQEGANSTLRCNFSDSVNNLQWFHQNPWGQLINLFYIPSGTKQNGRLSATTVATERYSLLYISSSQTTDSGVYFCAVGFNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 796 - protein, 247 aa, Homo sapiens
  TCR 38 - Alpha Cysteine-modified
GIQVEQSPPDLILQEGANSTLRCNFSDSVNNLQWFHQNPWGQLINLFYIPSGTKQNGRLSATTVATERYSLLYISSSQTTDSGVYFCAVGFNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 797 - protein, 279 aa, Homo sapiens
  TCR 38 - Alpha Native
MVKMPGARRQSIMKRILGALLGLLSAQVCCVRGIQVEQSPPDLILQEGANSTLRCNFSDSVNNLQWFHQNPWGQLINLFYIPSGTKQNGRLSATTVATERYSLLYISSSQTTDSGVYFCAVGFNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 798 - protein, 279 aa, Homo sapiens
  TCR 38 - Alpha Cysteine-modified
MVKMPGARRQSIMKRILGALLGLLSAQVCCVRGIQVEQSPPDLILQEGANSTLRCNFSDSVNNLQWFHQNPWGQLINLFYIPSGTKQNGRLSATTVATERYSLLYISSSQTTDSGVYFCAVGFNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 799 - protein, 106 aa, Homo sapiens
  TCR 38 Alpha variable region
GIQVEQSPPDLILQEGANSTLRCNFSDSVNNLQWFHQNPWGQLINLFYIPSGTKQNGRLSATTVATERYSLLYISSSQTTDSGVYFCAVGFNDMRFGAGTRLTVKP

SEQ ID NO: 800 - protein, 5 aa, Homo sapiens
  TCR 38 Alpha CDR1
DSVNN

SEQ ID NO: 801 - protein, 5 aa, Homo sapiens
  TCR 38 Alpha CDR2
IPSGT

SEQ ID NO: 802 - protein, 8 aa, Homo sapiens
  TCR 38 Alpha CDR3
AVGFNDMR

SEQ ID NO: 803 - protein, 32 aa, Homo sapiens
  TCR 38 Alpha signal peptide
MVKMPGARRQSIMKRILGALLGLLSAQVCCVR

SEQ ID NO: 804 - protein, 292 aa, Homo sapiens
  TCR 38 - Beta Native
ETGVTQSPTHLIKTRGQQVTLRCSSQSGHNTVSWYQQALGQGPQFIFQYYREEENGRGNFPPRFSGLQFPNYSSELNVNALELDDSALYLCASSLVAGGETQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 805 - protein, 292 aa, Homo sapiens
  TCR 38 - Beta Cysteine-modified
ETGVTQSPTHLIKTRGQQVTLRCSSQSGHNTVSWYQQALGQGPQFIFQYYREEENGRGNFPPRFSGLQFPNYSSELNVNALELDDSALYLCASSLVAGGETQYFGPGTRLLVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 806 - protein, 311 aa, Homo sapiens
  TCR 38 - Beta Native
MGPGLLCWVLLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSLVAGGETQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 807 - protein, 311 aa, Homo sapiens
  TCR 38 - Beta Cysteine-modified
MGPGLLCWVLLCLLGAGSVETGVTQSPTHLIKTRGQQVTLRCSSQSGHNTVSWYQQALGQGPQFIFQYYREEENGRGNFPPRFSGLQFPNYSSELNVNALELDDSALYLCASSLVAGGETQYFGPGTRLLVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 808 - protein, 113 aa, Homo sapiens
  TCR 38 Beta variable region
ETGVTQSPTHLIKTRGQQVTLRCSSQSGHNTVSWYQQALGQGPQFIFQYYREEENGRGNFPPRFSGLQFPNYSSELNVNALELDDSALYLCASSLVAGGETQYFGPGTRLLVL

SEQ ID NO: 809 - protein, 12 aa, Homo sapiens
  TCR 38 Beta CDR3
ASSLVAGGETQY

SEQ ID NO: 810 - protein, 19 aa, Homo sapiens
  TCR 38 Beta signal peptide
MGPGLLCWVLLCLLGAGSV

SEQ ID NO: 811 - protein, 253 aa, Homo sapiens
  TCR 39 - Alpha Native
GQQLNQSPQSMFIQEGEDVSMNCTSSSIFNTWLWYKQEPGEGPVLLIALYKAGELTSNGRLTAQFGITRKDSFLNISASIPSDVGIYFCAGYSSSNDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 812 - protein, 253 aa, Homo sapiens
  TCR 39 - Alpha Cysteine-modified
GQQLNQSPQSMFIQEGEDVSMNCTSSSIFNTWLWYKQEPGEGPVLLIALYKAGELTSNGRLTAQFGITRKDSFLNISASIPSDVGIYFCAGYSSSNDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 813 - protein, 260 aa, Homo sapiens
  TCR 39 - Alpha Native
MQLTWVSGQQLNQSPQSMFIQEGEDVSMNCTSSSIFNTWLWYKQEPGEGPVLLIALYKAGELTSNGRLTAQFGITRKDSFLNISASIPSDVGIYFCAGYSSSNDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 814 - protein, 260 aa, Homo sapiens
  TCR 39 - Alpha Cysteine-modified
MQLTWVSGQQLNQSPQSMFIQEGEDVSMNCTSSSIFNTWLWYKQEPGEGPVLLIALYKAGELTSNGRLTAQFGITRKDSFLNISASIPSDVGIYFCAGYSSSNDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 815 - protein, 112 aa, Homo sapiens
  TCR 39 Alpha variable region
GQQLNQSPQSMFIQEGEDVSMNCTSSSIFNTWLWYKQEPGEGPVLLIALYKAGELTSNGRLTAQFGITRKDSFLNISASIPSDVGIYFCAGYSSSNDYKLSFGAGTTVTVRA

SEQ ID NO: 816 - protein, 5 aa, Homo sapiens
  TCR 39/ TCR 40/ TCR 42/ TCR 45 Alpha CDR1
TTLSN

SEQ ID NO: 817 - protein, 7 aa, Homo sapiens
  TCR 39 Alpha CDR2
LYKAGEL

SEQ ID NO: 818 - protein, 12 aa, Homo sapiens
  TCR 39 Alpha CDR3
AGYSSSNDYKLS

SEQ ID NO: 819 - protein, 7 aa, Homo sapiens
  TCR 39 Alpha signal peptide
MQLTWVS

SEQ ID NO: 820 - protein, 291 aa, Homo sapiens
  TCR 39 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDRGKEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 821 - protein, 291 aa, Homo sapiens
  TCR 39 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDRGKEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 822 - protein, 310 aa, Homo sapiens
  TCR 39 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDRGKEAFFGQGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 823 - protein, 310 aa, Homo sapiens
  TCR 39 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDRGKEAFFGQGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 824 - protein, 114 aa, Homo sapiens
  TCR 39 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDRGKEAFFGQGTRLTVV

SEQ ID NO: 825 - protein, 12 aa, Homo sapiens
  TCR 39 Beta CDR3
ASTPRDRGKEAF

SEQ ID NO: 826 - protein, 251 aa, Homo sapiens
  TCR 40 - Alpha Native
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGRNNFNKFYFGSGTKLNVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 827 - protein, 251 aa, Homo sapiens
  TCR 40 - Alpha Cysteine-modified
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGRNNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 828 - protein, 305 aa, Homo sapiens
  TCR 40 - Alpha Native
MHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGRNNFNKFYFGSGTKLNVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 829 - protein, 305 aa, Homo sapiens
  TCR 40 - Alpha Cysteine-modified
MHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGRNNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 830 - protein, 110 aa, Homo sapiens
  TCR 40 Alpha variable region
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGRNNFNKFYFGSGTKLNVKP

SEQ ID NO: 831 - protein, 7 aa, Homo sapiens
  TCR 40 Alpha CDR2
LVKSGEV

SEQ ID NO: 832 - protein, 10 aa, Homo sapiens
  TCR 40/ TCR 42 Alpha CDR3
AGRNNFNKFY

SEQ ID NO: 833 - protein, 137 aa, Mus musculus
  Transmembrane-modified/cysteine modified mouse constant alpha
NIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 834 - protein, 54 aa, Homo sapiens
  TCR 40/ TCR 42/ TCR 45 Alpha signal peptide
MHTSTFQNRPQLFLLIWKKLVPGNPFRRSWMKREREMLLITSMLVLWMQLSQVN

SEQ ID NO: 835 - protein, 292 aa, Homo sapiens
  TCR 40 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCAITARSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 836 - protein, 292 aa, Homo sapiens
  TCR 40 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCAITARSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 837 - protein, 311 aa, Homo sapiens
  TCR 40 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITARSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 838 - protein, 311 aa, Homo sapiens
  TCR 40 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAITARSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 839 - protein, 113 aa, Homo sapiens
  TCR 40 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCAITARSSYEQYFGPGTRLTVT

SEQ ID NO: 840 - protein, 11 aa, Homo sapiens
  TCR 40 Beta CDR3
AITARSSYEQY

SEQ ID NO: 841 - protein, 253 aa, Homo sapiens
  TCR 41 - Alpha Native
RKEVEQDPGPFNVPEGATVAFNCTYSNSASQSFFWYRQDCRKEPKLLMSVYSSGNEDGRFTAQLNRASQYISLLIRDSKLSDSATYLCVVTFALTGGFKTIFGAGTRLFVKANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 842 - protein, 253 aa, Homo sapiens
  TCR 41 - Alpha Cysteine-modified
RKEVEQDPGPFNVPEGATVAFNCTYSNSASQSFFWYRQDCRKEPKLLMSVYSSGNEDGRFTAQLNRASQYISLLIRDSKLSDSATYLCVVTFALTGGFKTIFGAGTRLFVKANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 843 - protein, 275 aa, Homo sapiens
  TCR 41 - Alpha Native
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVTFALTGGFKTIFGAGTRLFVKANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 844 - protein, 275 aa, Homo sapiens
  TCR 41 - Alpha Cysteine-modified
MMISLRVLLVILWLQLSWVWSQRKEVEQDPGPFNVPEGATVAFNCTYSNSASQSFFWYRQDCRKEPKLLMSVYSSGNEDGRFTAQLNRASQYISLLIRDSKLSDSATYLCVVTFALTGGFKTIFGAGTRLFVKANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 845 - protein, 112 aa, Homo sapiens
  TCR 41 Alpha variable region
RKEVEQDPGPFNVPEGATVAFNCTYSNSASQSFFWYRQDCRKEPKLLMSVYSSGNEDGRFTAQLNRASQYISLLIRDSKLSDSATYLCVVTFALTGGFKTIFGAGTRLFVKA

SEQ ID NO: 846 - protein, 13 aa, Homo sapiens
  TCR 41 Alpha CDR3
VVTFALTGGFKTI

SEQ ID NO: 847 - protein, 294 aa, Homo sapiens
  TCR 41 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASNPRDRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 848 - protein, 294 aa, Homo sapiens
  TCR 41 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASNPRDRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 849 - protein, 313 aa, Homo sapiens
  TCR 41 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASNPRDRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 850 - protein, 313 aa, Homo sapiens
  TCR 41 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASNPRDRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 851 - protein, 115 aa, Homo sapiens
  TCR 41 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASNPRDRVSYEQYFGPGTRLTVT

SEQ ID NO: 852 - protein, 13 aa, Homo sapiens
  TCR 41 Beta CDR3
ASNPRDRVSYEQY

SEQ ID NO: 853 - protein, 251 aa, Homo sapiens
  TCR 42 - Alpha Native
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGPDNFNKFYFGSGTKLNVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 854 - protein, 251 aa, Homo sapiens
  TCR 42 - Alpha Cysteine-modified
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGPDNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 855 - protein, 305 aa, Homo sapiens
  TCR 42 - Alpha Native
MHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGPDNFNKFYFGSGTKLNVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 856 - protein, 305 aa, Homo sapiens
  TCR 42 - Alpha Cysteine-modified
MHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGPDNFNKFYFGSGTKLNVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 857 - protein, 110 aa, Homo sapiens
  TCR 42 Alpha variable region
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGPDNFNKFYFGSGTKLNVKP

SEQ ID NO: 858 - protein, 10 aa, Homo sapiens
  TCR 42 Alpha CDR3
AGPDNFNKFY

SEQ ID NO: 859 - protein, 292 aa, Homo sapiens
  TCR 42 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCAKTSRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 860 - protein, 292 aa, Homo sapiens
  TCR 42 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCAKTSRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 861 - protein, 311 aa, Homo sapiens
  TCR 42 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAKTSRSSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 862 - protein, 311 aa, Homo sapiens
  TCR 42 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAKTSRSSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 863 - protein, 113 aa, Homo sapiens
  TCR 42 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCAKTSRSSYEQYFGPGTRLTVT

SEQ ID NO: 864 - protein, 11 aa, Homo sapiens
  TCR 42 Beta CDR3
AKTSRSSYEQY

SEQ ID NO: 865 - protein, 254 aa, Homo sapiens
  TCR 43 - Alpha Native
QKEVEQNSGPLSVPEGAIASLNCTYSDRGSQSFFWYRQYSGKSPELIMFIYSNGDKEDGRFTAQLNKASQYVSLLIRDSQPSDSATYLCAVNVPTSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 866 - protein, 254 aa, Homo sapiens
  TCR 43 - Alpha Cysteine-modified
QKEVEQNSGPLSVPEGAIASLNCTYSDRGSQSFFWYRQYSGKSPELIMFIYSNGDKEDGRFTAQLNKASQYVSLLIRDSQPSDSATYLCAVNVPTSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 867 - protein, 276 aa, Homo sapiens
  TCR 43 - Alpha Native
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNVPTSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 868 - protein, 276 aa, Homo sapiens
  TCR 43 - Alpha Cysteine-modified
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNVPTSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 869 - protein, 113 aa, Homo sapiens
  TCR 43 Alpha variable region
QKEVEQNSGPLSVPEGAIASLNCTYSDRGSQSFFWYRQYSGKSPELIMFIYSNGDKEDGRFTAQLNKASQYVSLLIRDSQPSDSATYLCAVNVPTSGTYKYIFGTGTRLKVLA

SEQ ID NO: 870 - protein, 13 aa, Homo sapiens
  TCR 43 Alpha CDR3
AVNVPTSGTYKYI

SEQ ID NO: 871 - protein, 292 aa, Homo sapiens
  TCR 43 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 872 - protein, 292 aa, Homo sapiens
  TCR 43 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 873 - protein, 311 aa, Homo sapiens
  TCR 43 - Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 874 - protein, 311 aa, Homo sapiens
  TCR 43 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 875 - protein, 113 aa, Homo sapiens
  TCR 43 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRDSYEQYFGPGTRLTVT

SEQ ID NO: 876 - protein, 11 aa, Homo sapiens
  TCR 43 Beta CDR3
ASTPRDSYEQY

SEQ ID NO: 877 - protein, 251 aa, Homo sapiens
  TCR 44 - Alpha Native
GQNIDQPTEMTATEGAIVQINCTYQTSGFNGLFWYQQHAGEAPTFLSYNVLDGLEEKGRFSSFLSRSKGYSYLLLKELQMKDSASYLCAQYSGGYQKVTFGTGTKLQVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 878 - protein, 251 aa, Homo sapiens
  TCR 44 - Alpha Cysteine-modified
GQNIDQPTEMTATEGAIVQINCTYQTSGFNGLFWYQQHAGEAPTFLSYNVLDGLEEKGRFSSFLSRSKGYSYLLLKELQMKDSASYLCAQYSGGYQKVTFGTGTKLQVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 879 - protein, 285 aa, Homo sapiens
  TCR 44 - Alpha Native
MAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAQYSGGYQKVTFGTGTKLQVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 880 - protein, 285 aa, Homo sapiens
  TCR 44 - Alpha Cysteine-modified
MAQELGMQCQARGILQQMWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAQYSGGYQKVTFGTGTKLQVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 881 - protein, 110 aa, Homo sapiens
  TCR 44 Alpha variable region
GQNIDQPTEMTATEGAIVQINCTYQTSGFNGLFWYQQHAGEAPTFLSYNVLDGLEEKGRFSSFLSRSKGYSYLLLKELQMKDSASYLCAQYSGGYQKVTFGTGTKLQVIP

SEQ ID NO: 882 - protein, 11 aa, Homo sapiens
  TCR 44 Alpha CDR3
AQYSGGYQKVT

SEQ ID NO: 883 - protein, 290 aa, Homo sapiens
  TCR 44 - Beta Native
DSGVTQTPKHLITATGQRVTLRCSPRSGDLSVYWYQQSLDQGLQFLIQYYNGEERAKGNILERFSAQQFPDLHSELNLSSLELGDSALYFCASSGTPDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 884 - protein, 290 aa, Homo sapiens
  TCR 44 - Beta Cysteine-modified
DSGVTQTPKHLITATGQRVTLRCSPRSGDLSVYWYQQSLDQGLQFLIQYYNGEERAKGNILERFSAQQFPDLHSELNLSSLELGDSALYFCASSGTPDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 885 - protein, 309 aa, Homo sapiens
  TCR 44 - Beta Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSGTPDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 886 - protein, 309 aa, Homo sapiens
  TCR 44 - Beta Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSGTPDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 887 - protein, 110 aa, Homo sapiens
  TCR 44 Beta variable region
DSGVTQTPKHLITATGQRVTLRCSPRSGDLSVYWYQQSLDQGLQFLIQYYNGEERAKGNILERFSAQQFPDLHSELNLSSLELGDSALYFCASSGTPDTQYFGPGTRLTV

SEQ ID NO: 888 - protein, 10 aa, Homo sapiens
  TCR 44 Beta CDR3
ASSGTPDTQY

SEQ ID NO: 889 - protein, 180 aa, Homo sapiens
  TCR 44 Native TCR beta constant region
LEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 890 - protein, 180 aa, Homo sapiens
  TCR 44 TCR beta constant region
LEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 891 - protein, 253 aa, Homo sapiens
  TCR 45 - Alpha Native
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGSSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 892 - protein, 253 aa, Homo sapiens
  TCR 45 - Alpha Cysteine-modified
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGSSGAGSYQLTFGKGTKLSVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 893 - protein, 307 aa, Homo sapiens
  TCR 45 - Alpha Native
MHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGSSGAGSYQLTFGKGTKLSVIPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 894 - protein, 307 aa, Homo sapiens
  TCR 45 - Alpha Cysteine-modified
MHTSTFQNRPQLFLLIWKKLVPGNPFRRSWMKREREMLLITSMLVLWMQLSQVNGQQVMQIPQYQHVQEGEDFTTYCNSSTTLSNIQWYKQRPGGHPVFLIQLVKSGEVKKQKRLTFQFGEAKKNSSLHITATQTTDVGTYFCAGSSGAGSYQLTFGKGTKLSVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 895 - protein, 112 aa, Homo sapiens
  TCR 45 Alpha variable region
GQQVMQIPQYQHVQEGEDFTTYCNSSTTLSNIQWYKQRPGGHPVFLIQLVKSGEVKKQKRLTFQFGEAKKNSSLHITATQTTDVGTYFCAGSSGAGSYQLTFGKGTKLSVIP

SEQ ID NO: 896 - protein, 12 aa, Homo sapiens
  TCR 45 Alpha CDR3
AGSSGAGSYQLT

SEQ ID NO: 897 - protein, 294 aa, Homo sapiens
  TCR 45 - Beta Native
GAGVSQSPSNKVTEKGKDVELRCDPISGHTALYWYRQRLGQGLEFLIYFQGNSAPDKSGLPSDRFSAERTGESVSTLTIQRTQQEDSAVYLCASSLYLGTTGELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 898 - protein, 294 aa, Homo sapiens
  TCR 45 - Beta Cysteine-modified
GAGVSQSPSNKVTEKGKDVELRCDPISGHTALYWYRQRLGQGLEFLIYFQGNSAPDKSGLPSDRFSAERTGESVSTLTIQRTQQEDSAVYLCASSLYLGTTGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 899 - protein, 313 aa, Homo sapiens
  TCR 45 - Beta Native
MGTRLLFWVAFCLLGAYHTGAGVSQSPSNKVTEKGKDVELRCDPISGHTALYWYRQRLGQGLEFLIYFQGNSAPDKSGLPSDRFSAERTGESVSTLTIQRTQQEDSAVYLCASSLYLGTTGELFFGEGSRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 900 - protein, 313 aa, Homo sapiens
  TCR 45 - Beta Cysteine-modified
MGTRLLFWVAFCLLGAYHTGAGVSQSPSNKVTEKGKDVELRCDPISGHTALYWYRQRLGQGLEFLIYFQGNSAPDKSGLPSDRFSAERTGESVSTLTIQRTQQEDSAVYLCASSLYLGTTGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 901 - protein, 115 aa, Hom sapiens
  TCR 45 Beta variable region
GAGVSQSPSNKVTEKGKDVELRCDPISGHTALYWYRQRLGQGLEFLIYFQGNSAPDKSGLPSDRFSAERTGESVSTLTIQRTQQEDSAVYLCASSLYLGTTGELFFGEGSRLTVL

SEQ ID NO: 902 - protein, 13 aa, Homo sapiens
  TCR 45 Beta CDR3
ASSLYLGTTGELF

SEQ ID NO: 903 - protein, 19 aa, Homo sapiens
  TCR 45 Beta signal peptide
MGTRLLFWVAFCLLGAYHT

SEQ ID NO: 904 - protein, 255 aa, Homo sapiens
  TCR 46 - Alpha Native
AQSVTQLDSQVPVFEEAPVELRCNYSSSVSVYLFWYVQYPNQGLQLLLKYLSGSTLVKGINGFEAEFNKSQTSFHLRKPSVHISDTAEYFCAVSPSSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 905 - protein, 255 aa, Homo sapiens
  TCR 46 - Alpha Cysteine-modified
AQSVTQLDSQVPVFEEAPVELRCNYSSSVSVYLFWYVQYPNQGLQLLLKYLSGSTLVKGINGFEAEFNKSQTSFHLRKPSVHISDTAEYFCAVSPSSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 906 - protein, 274 aa, Homo sapiens
  TCR 46 - Alpha Native
MLLLLVPAFQVIFTLGGTRAQSVTQLDSQVPVFEEAPVELRCNYSSSVSVYLFWYVQYPNQGLQLLLKYLSGSTLVKGINGFEAEFNKSQTSFHLRKPSVHISDTAEYFCAVSPSSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 907 - protein, 274 aa, Homo sapiens
  TCR 46 - Alpha Cysteine-modified
MLLLLVPAFQVIFTLGGTRAQSVTQLDSQVPVFEEAPVELRCNYSSSVSVYLFWYVQYPNQGLQLLLKYLSGSTLVKGINGFEAEFNKSQTSFHLRKPSVHISDTAEYFCAVSPSSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 908 - protein, 114 aa, Homo sapiens
  TCR 46 Alpha variable region
AQSVTQLDSQVPVFEEAPVELRCNYSSSVSVYLFWYVQYPNQGLQLLLKYLSGSTLVKGINGFEAEFNKSQTSFHLRKPSVHISDTAEYFCAVSPSSGTYKYIFGTGTRLKVLA

SEQ ID NO: 909 - protein, 6 aa, Homo sapiens
  TCR 46 Alpha CDR1
SSVSVY

SEQ ID NO: 910 - protein, 8 aa, Homo sapiens
  TCR 46 Alpha CDR2
YLSGSTLV

SEQ ID NO: 911 - protein, 12 aa, Homo sapiens
  TCR 46 Alpha CDR3
AVSPSSGTYKYI

SEQ ID NO: 912 - protein, 19 aa, Homo sapiens
  TCR 46 Alpha signal peptide
MLLLLVPAFQVIFTLGGTR

SEQ ID NO: 913 - protein, 294 aa, Homo sapiens
  TCR 46 - Beta Native
GAGVSQTPSNKVTEKGKYVELRCDPISGHTALYWYRQSLGQGPEFLIYFQGTGAADDSGLPNDRFFAVRPEGSVSTLKIQRTERGDSAVYLCASSLYLGGSETQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 914 - protein, 294 aa, Homo sapiens
  TCR 46 - Beta Cysteine-modified
GAGVSQTPSNKVTEKGKYVELRCDPISGHTALYWYRQSLGQGPEFLIYFQGTGAADDSGLPNDRFFAVRPEGSVSTLKIQRTERGDSAVYLCASSLYLGGSETQYFGPGTRLLVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 915 - protein, 313 aa, Homo sapiens
  TCR 46 - Beta Native
MGTRLLCWAALCLLGADHTGAGVSQTPSNKVTEKGKYVELRCDPISGHTALYWYRQSLGQGPEFLIYFQGTGAADDSGLPNDRFFAVRPEGSVSTLKIQRTERGDSAVYLCASSLYLGGSETQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 916 - protein, 313 aa, Homo sapiens
  TCR 46 - Beta Cysteine-modified
MGTRLLCWAALCLLGADHTGAGVSQTPSNKVTEKGKYVELRCDPISGHTALYWYRQSLGQGPEFLIYFQGTGAADDSGLPNDRFFAVRPEGSVSTLKIQRTERGDSAVYLCASSLYLGGSETQYFGPGTRLLVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 917 - protein, 115 aa, Homo sapiens
  TCR 46 Beta variable region
GAGVSQTPSNKVTEKGKYVELRCDPISGHTALYWYRQSLGQGPEFLIYFQGTGAADDSGLPNDRFFAVRPEGSVSTLKIQRTERGDSAVYLCASSLYLGGSETQYFGPGTRLLVL

SEQ ID NO: 918 - protein, 6 aa, Homo sapiens
  TCR 46 Beta CDR2
FQGTGA

SEQ ID NO: 919 - protein, 13 aa, Homo sapiens
  TCR 46 Beta CDR3
ASSLYLGGSETQY

SEQ ID NO: 920 - protein, 19 aa, Homo sapiens
  TCR 46 Beta signal peptide
MGTRLLCWAALCLLGADHT

SEQ ID NO: 921 - protein, 254 aa, Homo sapiens
  TCR 47 - Alpha Native
QKEVEQNSGPLSVPEGAIASLNCTYSDRGSQSFFWYRQYSGKSPELIMFIYSNGDKEDGRFTAQLNKASQYVSLLIRDSQPSDSATYLCAVNLLSGSARQLTFGSGTQLTVLPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 922 - protein, 254 aa, Homo sapiens
  TCR 47 - Alpha Cysteine-modified
QKEVEQNSGPLSVPEGAIASLNCTYSDRGSQSFFWYRQYSGKSPELIMFIYSNGDKEDGRFTAQLNKASQYVSLLIRDSQPSDSATYLCAVNLLSGSARQLTFGSGTQLTVLPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 923 - protein, 276 aa, Homo sapiens
  TCR 47 - Alpha Native
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNLLSGSARQLTFGSGTQLTVLPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 924 - protein, 276 aa, Homo sapiens
  TCR 47 - Alpha Cysteine-modified
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNLLSGSARQLTFGSGTQLTVLPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 925 - protein, 113 aa, Homo sapiens
  TCR 47 Alpha variable region
QKEVEQNSGPLSVPEGAIASLNCTYSDRGSQSFFWYRQYSGKSPELIMFIYSNGDKEDGRFTAQLNKASQYVSLLIRDSQPSDSATYLCAVNLLSGSARQLTFGSGTQLTVLP

SEQ ID NO: 926 - protein, 13 aa, Homo sapiens
  TCR 47 Alpha CDR3
AVNLLSGSARQLT

SEQ ID NO: 927 - protein, 292 aa, Homo sapiens
  TCR 47 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRTTYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 928 - protein, 292 aa, Homo sapiens
  TCR 47 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRTTYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 929 - protein, 311 aa, Homo sapiens
  TCR 47- Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRTTYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 930 - protein, 311 aa, Homo sapiens
  TCR 47 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRTTYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 931 - protein, 113 aa, Homo sapiens
  TCR 47 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCAMTGRTTYEQYFGPGTRLTVT

SEQ ID NO: 932 - protein, 11 aa, Homo sapiens
  TCR 47 Beta CDR3
AMTGRTTYEQY

SEQ ID NO: 933 - protein, 252 aa, Homo sapiens
  TCR 48 - Alpha Native
QKEVEQDPGPLSVPEGAIVSLNCTYSNSAFQYFMWYRQYSRKGPELLMYTYSSGNKEDGRFTAQVDKSSKYISLFIRDSQPSDSATYLCAMRIQGAQKLVFGQGTRLTINPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 934 - protein, 252 aa, Homo sapiens
  TCR 48 - Alpha Cysteine-modified
QKEVEQDPGPLSVPEGAIVSLNCTYSNSAFQYFMWYRQYSRKGPELLMYTYSSGNKEDGRFTAQVDKSSKYISLFIRDSQPSDSATYLCAMRIQGAQKLVFGQGTRLTINPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 935 - protein, 274 aa, Homo sapiens
  TCR 48 - Alpha Native
MMKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMRIQGAQKLVFGQGTRLTINPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 936 - protein, 274 aa, Homo sapiens
  TCR 48 - Alpha Cysteine-modified
MMKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMRIQGAQKLVFGQGTRLTINPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 937 - protein, 111 aa, Homo sapiens
  TCR 48 Alpha variable region
QKEVEQDPGPLSVPEGAIVSLNCTYSNSAFQYFMWYRQYSRKGPELLMYTYSSGNKEDGRFTAQVDKSSKYISLFIRDSQPSDSATYLCAMRIQGAQKLVFGQGTRLTINP

SEQ ID NO: 938 - protein, 6 aa, Homo sapiens
  TCR 48 Alpha CDR1
NSAFQY

SEQ ID NO: 939 - protein, 6 aa, Homo sapiens
  TCR 48 Alpha CDR2
TYSSGN

SEQ ID NO: 940 - protein, 11 aa, Homo sapiens
  TCR 48 Alpha CDR3
AMRIQGAQKLV

SEQ ID NO: 941 - protein, 292 aa, Homo sapiens
  TCR 48 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTGRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 942 - protein, 292 aa, Homo sapiens
  TCR 48 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTGRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 943 - protein, 311 aa, Homo sapiens
  TCR 48- Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTGRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 944 - protein, 311 aa, Homo sapiens
  TCR 48 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTGRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 945 - protein, 113 aa, Homo sapiens
  TCR 48 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTGRVSYEQYFGPGTRLTVT

SEQ ID NO: 946 - protein, 11 aa, Homo sapiens
  TCR 48 Beta CDR3
ASTGRVSYEQY

SEQ ID NO: 947 - protein, 254 aa, Homo sapiens
  TCR 49 - Alpha Native
QKEVEQNSGPLSVPEGAIASLNCTYSDRGSQSFFWYRQYSGKSPELIMFIYSNGDKEDGRFTAQLNKASQYVSLLIRDSQPSDSATYLCAVNIGTSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 948 - protein, 254 aa, Homo sapiens
  TCR 49 - Alpha Cysteine-modified
QKEVEQNSGPLSVPEGAIASLNCTYSDRGSQSFFWYRQYSGKSPELIMFIYSNGDKEDGRFTAQLNKASQYVSLLIRDSQPSDSATYLCAVNIGTSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 949 - protein, 276 aa, Homo sapiens
  TCR 49 - Alpha Native
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNIGTSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 950 - protein, 276 aa, Homo sapiens
  TCR 49 - Alpha Cysteine-modified
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNIGTSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 951 - protein, 113 aa, Homo sapiens
  TCR 49 Alpha variable region
QKEVEQNSGPLSVPEGAIASLNCTYSDRGSQSFFWYRQYSGKSPELIMFIYSNGDKEDGRFTAQLNKASQYVSLLIRDSQPSDSATYLCAVNIGTSGTYKYIFGTGTRLKVLA

SEQ ID NO: 952 - protein, 13 aa, Homo sapiens
  TCR 49 Alpha CDR3
AVNIGTSGTYKYI

SEQ ID NO: 953 - protein, 292 aa, Homo sapiens
  TCR 49 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRYSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 954 - protein, 292 aa, Homo sapiens
  TCR 49 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRYSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 955 - protein, 311 aa, Homo sapiens
  TCR 49- Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRYSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 956 - protein, 311 aa, Homo sapiens
  TCR 49 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRYSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 957 - protein, 113 aa, Homo sapiens
  TCR 49 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCASTPRYSYEQYFGPGTRLTVT

SEQ ID NO: 958 - protein, 11 aa, Homo sapiens
  TCR 49 Beta CDR3
ASTPRYSYEQY

SEQ ID NO: 959 - protein, 252 aa, Homo sapiens
  TCR 50 - Alpha Native
GEDVEQSLFLSVREGDSSVINCTYTDSSSTYLYWYKQEPGAGLQLLTYIFSNMDMKQDQRLTVLLNKKDKHLSLRIADTQTGDSAIYFCAESPPGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 960 - protein, 252 aa, Homo sapiens
  TCR 50 - Alpha Cysteine-modified
GEDVEQSLFLSVREGDSSVINCTYTDSSSTYLYWYKQEPGAGLQLLTYIFSNMDMKQDQRLTVLLNKKDKHLSLRIADTQTGDSAIYFCAESPPGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 961 - protein, 273 aa, Homo sapiens
  TCR 50 - Alpha Native
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESPPGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 962 - protein, 273 aa, Homo sapiens
  TCR 50 - Alpha Cysteine-modified
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAESPPGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 963 - protein, 111 aa, Homo sapiens
  TCR 50 Alpha variable region
GEDVEQSLFLSVREGDSSVINCTYTDSSSTYLYWYKQEPGAGLQLLTYIFSNMDMKQDQRLTVLLNKKDKHLSLRIADTQTGDSAIYFCAESPPGTYKYIFGTGTRLKVLA

SEQ ID NO: 964 - protein, 11 aa, Homo sapiens
  TCR 50 Alpha CDR3
AESPPGTYKYI

SEQ ID NO: 965 - protein, 290 aa, Homo sapiens
  TCR 50 - Beta Native
DSGVTQTPKHLITATGQRVTLRCSPRSGDLSVYWYQQSLDQGLQFLIHYYNGEERAKGNILERFSAQQFPDLHSELNLSSLELGDSALYFCASSATRDAYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 966 - protein, 290 aa, Homo sapiens
  TCR 50 - Beta Cysteine-modified
DSGVTQTPKHLITATGQRVTLRCSPRSGDLSVYWYQQSLDQGLQFLIHYYNGEERAKGNILERFSAQQFPDLHSELNLSSLELGDSALYFCASSATRDAYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 967 - protein, 309 aa, Homo sapiens
  TCR 50- Beta Native
MGFRLLCCVAFCLLGAGPVDSGVTQTPKHLITATGQRVTLRCSPRSGDLSVYWYQQSLDQGLQFLIHYYNGEERAKGNILERFSAQQFPDLHSELNLSSLELGDSALYFCASSATRDAYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 968 - protein, 309 aa, Homo sapiens
  TCR 50 - Beta Cysteine-modified
MGFRLLCCVAFCLLGAGPVDSGVTQTPKHLITATGQRVTLRCSPRSGDLSVYWYQQSLDQGLQFLIHYYNGEERAKGNILERFSAQQFPDLHSELNLSSLELGDSALYFCASSATRDAYGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 969 - protein, 113 aa, Homo sapiens
  TCR 50 Beta variable region
DSGVTQTPKHLITATGQRVTLRCSPRSGDLSVYWYQQSLDQGLQFLIHYYNGEERAKGNILERFSAQQFPDLHSELNLSSLELGDSALYFCASSATRDAYGYTFGSGTRLTVV

SEQ ID NO: 970 - protein, 12 aa, Homo sapiens
  TCR 50 Beta CDR3
ASSATRDAYGYT

SEQ ID NO: 971 - protein, 255 aa, Homo sapiens
  TCR 51 - Alpha Native
QKEVEQNSGPLSVPEGAIASLNCTYSDRGSQSFFWYRQYSGKSPELIMSIYSNGDKEDGRFTAQLNKASQYVSLLIRDSQPSDSATYLCAVNMRGGGSNYKLTFGKGTLLTVNPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 972 - protein, 255 aa, Homo sapiens
  TCR 51 - Alpha Cysteine-modified
QKEVEQNSGPLSVPEGAIASLNCTYSDRGSQSFFWYRQYSGKSPELIMSIYSNGDKEDGRFTAQLNKASQYVSLLIRDSQPSDSATYLCAVNMRGGGSNYKLTFGKGTLLTVNPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 973 - protein, 277 aa, Homo sapiens
  TCR 51 - Alpha Native
MMKSLRVLLVILWLQLSWVWSQQKEVEQNSGPLSVPEGAIASLNCTYSDRGSQSFFWYRQYSGKSPELIMSIYSNGDKEDGRFTAQLNKASQYVSLLIRDSQPSDSATYLCAVNMRGGGSNYKLTFGKGTLLTVNPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 974 - protein, 277 aa, Homo sapiens
  TCR 51 - Alpha Cysteine-modified
MMKSLRVLLVILWLQLSWVWSQQKEVEQNSGPLSVPEGAIASLNCTYSDRGSQSFFWYRQYSGKSPELIMSIYSNGDKEDGRFTAQLNKASQYVSLLIRDSQPSDSATYLCAVNMRGGGSNYKLTFGKGTLLTVNPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 975 - protein, 114 aa, Homo sapiens
  TCR 51 Alpha variable region
QKEVEQNSGPLSVPEGAIASLNCTYSDRGSQSFFWYRQYSGKSPELIMSIYSNGDKEDGRFTAQLNKASQYVSLLIRDSQPSDSATYLCAVNMRGGGSNYKLTFGKGTLLTVNP

SEQ ID NO: 976 - protein, 14 aa, Homo sapiens
  TCR 51 Alpha CDR3
AVNMRGGGSNYKLT

SEQ ID NO: 977 - protein, 292 aa, Homo sapiens
  TCR 51 - Beta Native
EPEVTQTPSHQVTQMGQEVILRCVPISNHLYFYWYRQILGQKVEFLVSFYNNEISEKSEIFDDQFSVERPDGSNFTLKIRSTKLEDSAMYFCAIASRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 978 - protein, 292 aa, Homo sapiens
  TCR 51 - Beta Cysteine-modified
EPEVTQTPSHQVTQMGQEVILRCVPISNHLYFYWYRQILGQKVEFLVSFYNNEISEKSEIFDDQFSVERPDGSNFTLKIRSTKLEDSAMYFCAIASRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 979 - protein, 311 aa, Homo sapiens
  TCR 51- Beta Native
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAIASRVSYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 980 - protein, 311 aa, Homo sapiens
  TCR 51 - Beta Cysteine-modified
MDTWLVCWAIFSLLKAGLTEPEVTQTPSHQVTQMGQEVILRCVPISNHLYFYWYRQILGQKVEFLVSFYNNEISEKSEIFDDQFSVERPDGSNFTLKIRSTKLEDSAMYFCAIASRVSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 981 - protein, 113 aa, Homo sapiens
  TCR 51 Beta variable region
EPEVTQTPSHQVTQMGQEVILRCVPISNHLYFYWYRQILGQKVEFLVSFYNNEISEKSEIFDDQFSVERPDGSNFTLKIRSTKLEDSAMYFCAIASRVSYEQYFGPGTRLTVT

SEQ ID NO: 982 - protein, 11 aa, Homo sapiens
  TCR 51 Beta CDR3
AIASRVSYEQY

SEQ ID NO: 983 - protein, 250 aa, Homo sapiens
  TCR 52 - Alpha Native
TQLLEQSPQFLSIQEGENLTVYCNSSSVFSSLQWYRQEPGEGPVLLVTVVTGGEVKKLKRLTFQFGDARKDSSLHITAAQPGDTGLYLCAGARDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 984 - protein, 250 aa, Homo sapiens
  TCR 52 - Alpha Cysteine-modified
TQLLEQSPQFLSIQEGENLTVYCNSSSVFSSLQWYRQEPGEGPVLLVTVVTGGEVKKLKRLTFQFGDARKDSSLHITAAQPGDTGLYLCAGARDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 985 - protein, 268 aa, Homo sapiens
  TCR 52 - Alpha Native
MVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGARDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 986 - protein, 268 aa, Homo sapiens
  TCR 52 - Alpha Cysteine-modified
MVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGARDYKLSFGAGTTVTVRANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 987 - protein, 109 aa, Homo sapiens
  TCR 52 Alpha variable region
TQLLEQSPQFLSIQEGENLTVYCNSSSVFSSLQWYRQEPGEGPVLLVTVVTGGEVKKLKRLTFQFGDARKDSSLHITAAQPGDTGLYLCAGARDYKLSFGAGTTVTVRA

SEQ ID NO: 988 - protein, 9 aa, Homo sapiens
  TCR 52 Alpha CDR3
AGARDYKLS

SEQ ID NO: 989 - protein, 292 aa, Homo sapiens
  TCR 52 - Beta Native
DSGVTQTPKHLITATGQRVTLRCSPRSGDLSVYWYQQSLDQGLQFLIQYYNGEERAKGNILERFSAQQFPDLHSELNLSSLELGDSALYFCASSVGDLNNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 990 - protein, 292 aa, Homo sapiens
  TCR 52 - Beta Cysteine-modified
DSGVTQTPKHLITATGQRVTLRCSPRSGDLSVYWYQQSLDQGLQFLIQYYNGEERAKGNILERFSAQQFPDLHSELNLSSLELGDSALYFCASSVGDLNNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 991 - protein, 311 aa, Homo sapiens
  TCR 52- Beta Native
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGDLNNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 992 - protein, 311 aa, Homo sapiens
  TCR 52 - Beta Cysteine-modified
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVGDLNNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 993 - protein, 113 aa, Homo sapiens
  TCR 52 Beta variable region
DSGVTQTPKHLITATGQRVTLRCSPRSGDLSVYWYQQSLDQGLQFLIQYYNGEERAKGNILERFSAQQFPDLHSELNLSSLELGDSALYFCASSVGDLNNEQFFGPGTRLTVL

SEQ ID NO: 994 - protein, 12 aa, Homo sapiens
  TCR 52 Beta CDR3
ASSVGDLNNEQF

SEQ ID NO: 995 - protein, 256 aa, Homo sapiens
  TCR 53 - Alpha Native
AQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDFGSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 996 - protein, 256 aa, Homo sapiens
  TCR 53 - Alpha Cysteine-modified
AQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDFGSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 997 - protein, 275 aa, Homo sapiens
  TCR 53 - Alpha Native
MASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDFGSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 998 - protein, 275 aa, Homo sapiens
  TCR 53 - Alpha Cysteine-modified
MASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDFGSGTYKYIFGTGTRLKVLANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 999 - protein, 115 aa, Homo sapiens
  TCR 53 Alpha variable region
AQSVAQPEDQVNVAEGNPLTVKCTYSVSGNPYLFWYVQYPNRGLQFLLKYITGDNLVKGSYGFEAEFNKSQTSFHLKKPSALVSDSALYFCAVRDFGSGTYKYIFGTGTRLKVLA

SEQ ID NO: 1000 - protein, 6 aa, Homo sapiens
  TCR 53 Alpha CDR1
VSGNPY

SEQ ID NO: 1001 - protein, 8 aa, Homo sapiens
  TCR 53 Alpha CDR2
YITGDNLV

SEQ ID NO: 1002 - protein, 13 aa, Homo sapiens
  TCR 53 Alpha CDR3
AVRDFGSGTYKYI

SEQ ID NO: 1003 - protein, 19 aa, Homo sapiens
  TCR 53 Alpha CDR3
MASAPISMLAMLFTLSGLR

SEQ ID NO: 1004 - protein, 295 aa, Homo sapiens
  TCR 53 - Beta Native
GAGVSQSPRYKVTKRGQDVALRCDPISGHVSLYWYRQALGQGPEFLTYFNYEAQQDKSGLPNDRFSAERPEGSISTLTIQRTEQRDSAMYRCASSGSGTSGYNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 1005 - protein, 295 aa, Homo sapiens
  TCR 53 - Beta Cysteine-modified
GAGVSQSPRYKVTKRGQDVALRCDPISGHVSLYWYRQALGQGPEFLTYFNYEAQQDKSGLPNDRFSAERPEGSISTLTIQRTEQRDSAMYRCASSGSGTSGYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 1006 - protein, 314 aa, Homo sapiens
  TCR 53- Beta Native
MGTSLLCWVVLGFLGTDHTGAGVSQSPRYKVTKRGQDVALRCDPISGHVSLYWYRQALGQGPEFLTYFNYEAQQDKSGLPNDRFSAERPEGSISTLTIQRTEQRDSAMYRCASSGSGTSGYNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 1007 - protein, 314 aa, Homo sapiens
  TCR 53 - Beta Cysteine-modified
MGTSLLCWVVLGFLGTDHTGAGVSQSPRYKVTKRGQDVALRCDPISGHVSLYWYRQALGQGPEFLTYFNYEAQQDKSGLPNDRFSAERPEGSISTLTIQRTEQRDSAMYRCASSGSGTSGYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 1008 - protein, 116 aa, Homo sapiens
  TCR 53 Beta variable region
GAGVSQSPRYKVTKRGQDVALRCDPISGHVSLYWYRQALGQGPEFLTYFNYEAQQDKSGLPNDRFSAERPEGSISTLTIQRTEQRDSAMYRCASSGSGTSGYNEQFFGPGTRLTVL

SEQ ID NO: 1009 - protein, 6 aa, Homo sapiens
  TCR 53 Beta CDR2
FNYEAQ

SEQ ID NO: 1010 - protein, 14 aa, Homo sapiens
  TCR 53 Beta CDR3
ASSGSGTSGYNEQF

SEQ ID NO: 1011 - protein, 19 aa, Homo sapiens
  TCR 53 Beta signal peptide
MGTSLLCWVVLGFLGTDHT

SEQ ID NO: 1012 - protein, 136 aa, Mus musculus
  Mouse alpha constant
IQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 1013 - protein, 173 aa, Mus musculus
  Mouse beta constant
EDLRNVTPPKVSLFEPSKAEIANKQKATLVCLARGFFPDHVELSWWVNGKEVHSGVCTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 1014 - protein, 137 aa, Mus musculus; identical to SEQ ID NO: 317
  Mouse alpha constant

SEQ ID NO: 1015 - protein, 137 aa, Mus musculus
  Mouse alpha constant
  VARIANT 48, 112, 114, 115: X = unknown or other
NIQNPEPAVYQLKDPRSQDSTLCLFTDFDSQINVPKTMESGTFITDKXVLDMKAMDSKSNGAIAWSNQTSFTCQDIFKETNATYPSSDVPCDATLTEKSFETDMNLNFQNLXVXXLRILLLKVAGFNLLMTLRLWSS

SEQ ID NO: 1016 - protein, 173 aa, Mus musculus
  Mouse beta constant
  VARIANT 57: X = unknown or other
EDLRNVTPPKVSLFEPSKAEIANKQKATLVCLARGFFPDHVELSWWVNGKEVHSGVXTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 1017 - protein, 137 aa, Mus musculus
  Mouse beta constant Cysteine-substituted
NIQNPEPAVYQLKDPRSQDSTLCLFTDFDSQINVPKTMESGTFITDKCVLDMKAMDSKSNGAIAWSNQTSFTCQDIFKETNATYPSSDVPCDATLTEKSFETDMNLNFQNLSVMGLRILLLKVAGFNLLMTLRLWSS

SEQ ID NO: 1018 - protein, 137 aa, Mus musculus
  Mouse alpha constant Transmembrane modified
NIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLLVIVLRILLLKVAGFNLLMTLRLWSS

SEQ ID NO: 1019 - DNA, 498 bp, Homo sapiens
  TCR 17 - Alpha  Native
gagtaattcttctctcaccatgccaggttcacttcacagtacagagtcctgaaaataaagaagaaaatttttttttatctagaaaaagaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatccaagttatggtctattctggtacaagcagcccagcagtggggaaatgatttttcttatttatcaggggtcttatgaccagcaaaatgcaacagaaggtcgctactcattgaatttccagaaggcaagaaaatccgccaaccttgtcatctccgcttcacaactgggggactcagcaatgtacttctgtgcaatgagagagggccggggtgacaagatcatctttggaaaagggacacgacttcatattctcccc

SEQ ID NO: 1020 - DNA, 420 bp, Homo sapiens; identical to SEQ ID NO: 431
  TCR 17 - Beta Native

SEQ ID NO: 1021 - DNA, 481 bp, Homo sapiens
  TCR 18 - Alpha Native
agagtgtttatcttgtgagccattctccatatttcagatataagatttcagttctcagtgagtctaagtgacagaaggaatggagaccctcttgggcctgcttatcctttggctgcagctgcaatgggtgagcagcaaacaggaggtgacgcagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgaggggaatgctggtggtactagctatggaaagctgacatttggacaagggaccatcttgactgtccatcca

SEQ ID NO: 1022 - DNA, 420 bp, Homo sapiens
  TCR 18 - Beta Native
gattctttcttcaaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttttgggggcgatctaattcacccctccactttgggaacgggaccaggctcactgtgaca

SEQ ID NO: 1023 - DNA, 501 bp, Homo sapiens
  TCR 19 - Alpha Native
gaattcttctctcaccatgccaggttcacctcacagtacagagtcctgaaaataaagaagaagatttttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctattctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagagaataccggcactgccagtaaactcacctttgggactggaacaagacttcaggtcacgctc

SEQ ID NO: 1024 - DNA, 420 bp, Homo sapiens
  TCR 19 - Beta Native
gattctttcttcaaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagttcttggggacaaagcacaggcgagcagtacttcgggccgggcaccaggctcacggtcaca

SEQ ID NO: 1025 - DNA, 516 bp, Homo sapiens
  TCR 20 - Alpha Native
gagaagcctcacacagcccagtaactttgctagtacctcttgagtgcaaggtggagaattaagatctggatttgagacggagcacggaacatttcactcaggggaagagctatgaacatgctgactgccagcctgttgagggcagtcatagcctccatctgtgttgtatccagcatggctcagaaggtaactcaagcgcagactgaaatttctgtggtggagaaggaggatgtgaccttggactgtgtgtatgaaacccgtgatactacttattacttattctggtacaagcaaccaccaagtggagaattggttttccttattcgtcggaactcttttgatgagcaaaatgaaataagtggtcggtattcttggaacttccagaaatccaccagttccttcaacttcaccatcacagcctcacaagtcgtggactcagcagtatacttctgtgctctgtggactggggcaaacaacctcttctttgggactggaacgagactcaccgttattccc

SEQ ID NO: 1026 - DNA, 436 bp, Homo sapiens
  TCR 20  - Beta Native
gacaactctccccagagaaggtggtgtgaggccatcacggaagatgctgctgcttctgctgcttctggggccaggctccgggcttggtgctgtcgtctctcaacatccgagcagggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagctcgttggcccgtcgctcctacgagcagtacttcgggccgggcaccaggctcacggtcaca

SEQ ID NO: 1027 - DNA, 510 bp, Homo sapiens
  TCR 21 - Alpha Native
gagtaattcttctctcaccatgccaggttcacctcacagtacagagtcctgaaaataaagaagaagatttttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctattctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagagggccgggtcacgggaggaggaaacaaactcacctttgggacaggcactcagctaaaagtggaactc

SEQ ID NO: 1028 - DNA, 480 bp, Homo sapiens
  TCR 21 - Beta Native
gagaatgacccccttgagagtactgttcccctatcaccgatgcacagacccagaagacccctccatcctgtagcacctgccatgagcatcgggctcctgtgctgtgtggccttttctctcctgtgggcaagtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcaggccctgggggaaccagaacactgaagctttctttggacaaggcaccagactcacagttgta

SEQ ID NO: 1029 - DNA, 468 bp, Homo sapiens
  TCR 22 - Alpha Native
acatgaagtgtctaccttctgcagactccaatggctcaggaactgggaatgcagtgccaggctcgtggtatcctgcagcagatgtggggagttttccttctttatgtttccatgaagatgggaggcactacaggacaaaacattgaccagcccactgagatgacagctacggaaggtgccattgtccagatcaactgcacgtaccagacatctgggttcaacgggctgttctggtaccagcaacatgctggcgaagcacccacatttctgtcttacaatgttctggatggtttggaggagaaaggtcgtttttcttcattccttagtcggtctaaagggtacagttacctccttttgaaggagctccagatgaaagactctgcctcttacctctgtgctgtgcgcgcacgtatggatagcaactatcagttaatctggggcgctgggaccaagctaattataaagcca

SEQ ID NO: 1030 - DNA, 444 bp, Homo sapiens
  TCR 22 - Beta Native
gaggaggaccaagccctgaatcaggtgcagtgctgcctgccccactgtgccatgggccctgggctcctctgctgggtgctgctttgtctcctgggagcaggcccagtggacgctggagtcacccaaagtcccacacacctgatcaaaacgagaggacagcacgtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcagccgaactgaaaactatggctacaccttcggttcggggaccaggttaaccgttgta

SEQ ID NO: 1031 - DNA, 501 bp, Homo sapiens
  TCR 23 - Alpha Native
gaattcttctctcaccatgccaggttcacctcacagtacagagtcctgaaaataaagaagaagatttttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctattctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagtcctccgggtggttctgcaaggcaactgacctttggatctgggacacaattgactgttttacct

SEQ ID NO: 1032 - DNA, 413 bp, Homo sapiens
  TCR  23 - Beta Native
gcttcaaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtccctggggacaaagcaatcagccccagcattttggtgatgggactcgactctccatccta

SEQ ID NO: 1033 - DNA, 504 bp, Homo sapiens
  TCR 24 - Alpha Native
gaattcttctctcaccatgccaggttcacctcacagtacagagtcctgaaaataaagaagaagatttttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctcttctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagagggcaggggtgacagctgggggaaattgcagtttggagcagggacccaggttgtggtcacccca

SEQ ID NO: 1034 - DNA, 420 bp, Homo sapiens
  TCR 24 - Beta Native
gattctttcttcaaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagccccttcgggaggggctcctacgagcagtacttcgggccgggcaccaggctcacggtcaca

SEQ ID NO: 1035 - DNA, 508 bp, Homo sapiens
  TCR 25 - Alpha Native
agtaattcttctctcaccatgccaggttcacctcacagtacagagtcctgaaaataaagaagaagattttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctcttctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagagggctcgctcacgggaggaggaaacaaactcacctttgggacaggcactcagctaaaagtggaactc

SEQ ID NO: 1036 - DNA, 422 bp, Homo sapiens
  TCR 25 - Beta Native
gctattctttcttcaaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatggggacagagcaatcagccccagcattttggtgatgggactcgactctccatccta

SEQ ID NO: 1037 - DNA, 498 bp, Homo sapiens
  TCR 26 - Alpha Native
gagtaattcttctctcaccatgccaggttcacctcacagtacagagtcctgaaaataaagaagaagatttttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctcttctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagacgcccggaacaatgacatgcgctttggagcagggaccagactgacagtaaaacca

SEQ ID NO: 1038 - DNA, 437 bp, Homo sapiens
  TCR 26 - Beta Native
acagacccagaggacccctccatcctgcagttcctgccatgagcctcgggctcctgtgctgtggggccttttctctcctgtgggcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttactatgctagcgggagaaactacgagcagtacttcgggccgggcaccaggctcacggtc

SEQ ID NO: 1039 - DNA, 410 bp, Homo sapiens
  TCR 27  - Alpha Native
gaatgtgcacttgaacaatgaagttggtgacaagcattactgtactcctatctttgggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagtccccccccagtctgggggttaccagaaagttacctttggaactggaacaaagctccaagtcatccca

SEQ ID NO: 1040 - DNA, 480 bp, Homo sapiens
  TCR 27 - Beta Native
gagaatgacccccttgagagtactgttcccctatcaccgatgcacagacccagaagacccctccatcctgtagcacctgccatgagcatcgggctcctgtgctgtgtggccttttctctcctgtgggcaagtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaatttgggagcttgaatgaaaaactgttttttggcagtggaacccagctctctgtcttg

SEQ ID NO: 1041 - DNA, 513 bp, Homo sapiens
  TCR 28 - Alpha Native
aggacagattctttttatgattcctaaagtggaagaaataaagtatctctgctatgttcatttctttttggattgaaaattttaatcctcagtgaaccagggcagaaaagaatgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgagggggggtggtactagctatggaaagctgacatttggacaagggaccatcttgactgtccatcca

SEQ ID NO: 1042 - DNA, 427 bp, Homo sapiens
  TCR 28 - Beta Native
gacctattctttcttcaaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagcttgtggggcaggagctctggaaacaccatatattttggagagggaagttggctcactgttgta

SEQ ID NO: 1043 - DNA, 493 bp, Homo sapiens
  TCR  29 - Alpha Native
gtctcaccatgccaggttcacctcacagtacagagtcctgaaaataaagaagaagatttttttttatctagaaaaggaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatcaaagttatggtctattttggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagactaaataccggcactgccagtaaactcacctttgggactggaacaagacttcaggtcacgctc

SEQ ID NO: 1044 - DNA, 514 bp, Homo sapiens
  TCR 29 - Beta Native
attccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtctcctgggagcaaacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtccctgggggcgggcaaccaatgagcagttcttcgggccagggacacggctcaccgtgcta

SEQ ID NO: 1045 - DNA, 490 bp, Homo sapiens
  TCR 30 - Alpha Native
gagtagctgttgcttctgttctctggaaattctttaaacctagaatcagacacaaaaactgaactctgggtccacaatcctcatttgtccttgaagtatgaggctggtggcaagagtaactgtgtttctgacctttggaactataattgatgctaagaccacccagcccccctccatggattgcgctgaaggaagagctgcaaacctgccttgtaatcactctaccatcagtggaaatgagtatgtgtattggtatcgacagattcactcccaggggccacagtatatcattcatggtctaaaaaacaatgaaaccaatgaaatggcctctctgatcatcacagaagacagaaagtccagcaccttgatcctgccccacgctacgctgagagacactgctgtgtactattgcatcgtcagaggcacctctgtcttgcagggaaatgagaaattaacctttgggactggaacaagactcaccatcataccc

SEQ ID NO: 1046 - DNA, 456 bp, Homo sapiens
  TCR 30  - Beta Native
gacaggaccagatgcctgagctaggaaaggcctcattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtcgacagcccagctctggaaacaccatatattttggagagggaagttggctcactgttgta

SEQ ID NO: 1047 - DNA, 1489 bp, Homo sapiens
  Human TCR beta constant 2 (TRBC2)
  ref <308>: DATABASE ACCESSION NUMBER: NCBI NG_001333.2
  ref <309>: DATABASE ENTRY DATE: 2016-08-31
aggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcggacaagactagatccagaagaaagccagagtggacaaggtgggatgatcaaggttcacagggtcagcaaagcacggtgtgcacttcccccaccaagaagcatagaggctgaatggagcacctcaagctcattcttccttcagatcctgacaccttagagctaagctttcaagtctccctgaggaccagccatacagctcagcatctgagtggtgtgcatcccattctcttctggggtcctggtttcctaagatcatagtgaccacttcgctggcactggagcagcatgagggagacagaaccagggctatcaaaggaggctgactttgtactatctgatatgcatgtgtttgtggcctgtgagtctgtgatgtaaggctcaatgtccttacaaagcagcattctctcatccatttttcttcccctgttttctttcagactgtggcttcacctccggtaagtgagtctctcctttttctctctatctttcgccgtctctgctctcgaaccagggcatggagaatccacggacacaggggcgtgagggaggccagagccacctgtgcacaggtgcctacatgctctgttcttgtcaacagagtcttaccagcaaggggtcctgtctgccaccatcctctatgagatcttgctagggaaggccaccttgtatgccgtgctggtcagtgccctcgtgctgatggccatggtaaggaggagggtgggatagggcagatgatgggggcaggggatggaacatcacacatgggcataaaggaatctcagagccagagcacagcctaatatatcctatcacctcaatgaaaccataatgaagccagactggggagaaaatgcagggaatatcacagaatgcatcatgggaggatggagacaaccagcgagccctactcaaattaggcctcagagcccgcctcccctgccctactcctgctgtgccatagcccctgaaaccctgaaaatgttctctcttccacaggtcaagagaaaggattccagaggctag

SEQ ID NO: 1048 - RNA, 20 nt, Artificial Sequence
  TRAC gRNA targeting domain
gagaaucaaaaucggugaau

SEQ ID NO: 1049 - DNA, 467 bp, Homo sapiens
  TCR 32 - Alpha Native
gagcccagagaagtctgttccaggacgggctctttcaggagcagctaaagtcaggggccatgtccaccatgtgatagaaagacaagatggtcctgaaattctccgtgtccattctttggattcagttggcatgggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagcctggtgatacaggcctctacctctgtgcaggaggtagcaactataaactgacatttggaaaaggaactctcttaaccgtgaatcca

SEQ ID NO: 1050 - DNA, 447 bp, Homo sapiens
  TCR  32- Beta Native
gagaatgcttactacagagacaccagccccaagctaggagatcctgccatgggcttcaggctcctctgctgtgtggccttttgtctcctgggagcaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcagcgtagggggggatcattctgatgagcagttcttcgggccagggacacggctcaccgtgcta

SEQ ID NO: 1051 - DNA, 508 bp, Homo sapiens
  TCR 33 - Alpha Native
gaaagcagattctttttatgatttttaaagtagaaatatccattctaggtgcattttttaagggtttaaaatttgaatcctcagtgaaccagggcagagaagaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacgcgcaccatactggaggcttcaaaactatctttggagcaggaacaagactatttgttaaagca

SEQ ID NO: 1052 - DNA, 417 bp, Homo sapiens
  TCR 33  - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccccacgggacacctacgagcagtacttcgggccgggcaccaggctcacggtcaca

SEQ ID NO: 1053 - RNA, 20 nt, Artificial Sequence
  TRBC gRNA targeting domain
ggccucggcgcugacgaucu

SEQ ID NO: 1054 - DNA, 20 bp, Homo sapiens
  TRBC target sequence
agatcgtcagcgccgaggcc

SEQ ID NO: 1055 - DNA, 397 bp, Homo sapiens
  TCR 35 - Alpha Native
gattttggccatggctttgcagagcactctgggggcggtgtggctagggcttctcctcaactctctctggaaggttgcagaaagcaaggaccaagtgtttcagccttccacagtggcatcttcagagggagctgtggtggaaatcttctgtaatcactctgtgtccaatgcttacaacttcttctggtaccttcacttcccgggatgtgcaccaagactccttgttaaaggctcaaagccttctcagcagggacgatacaacatgacctatgaacggttctcttcatcgctgctcatcctccaggtgcgggaggcagatgctgctgtttactactgtgctgtggcgggcgactacaagctcagctttggagccggaaccacagtaactgtaagagca

SEQ ID NO: 1056 - DNA, 450 bp, Homo sapiens
  TCR 35 - Beta Native
gagaatgcttactacagagacaccagccccaagctaggagatcctgccatgggcttcaggctcctctgctgtgtggccttttgtctcctgggagcaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagtacaactagcggggattcctcctacaatgagcagttcttcgggccagggacacggctcaccgtgcta

SEQ ID NO: 1057 - DNA, 511 bp, Homo sapiens
  TCR 36 - Alpha Native
gaggacagattctttttatgattcctaaagtggaagaaataaagtatctctgctatgttcatttctttttggattgaaaattttaatcctcagtgaaccagggcagaaaagaatgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaaccgggataactatggtcagaattttgtctttggtcccggaaccagattgtccgtgctgccc

SEQ ID NO: 1058 - DNA, 416 bp, Homo sapiens
  TCR 36 - Beta Native
attcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccatgaccggacggagcaactacgagcagtacttcgggccgggcaccaggctcacggtcaca

SEQ ID NO: 1059 - DNA, 464 bp, Homo sapiens
  TCR 37 - Alpha Native
gatatttggatagccctggccaactttcaaggctcctaaatctgagttttcagtgaactggacagaaaaaaaaaatgaagaagctactagcaatgattctgtggcttcaactagaccggttaagtggagagctgaaagtggaacaaaaccctctgttcctgagcatgcaggagggaaaaaactataccatctactgcaattattcaaccacttcagacagactgtattggtacaggcaggatcctgggaaaagtctggaatctctgtttgtgttgctatcaaatggagcagtgaagcaggagggacgattaatggcctcacttgataccaaagcccgtctcagcaccctccacatcacagctgccgtgcatgacctctctgccacctacttctgtgccgggtactctggggctgggagttaccaactcactttcgggaaggggaccaaactctcggtcatacca

SEQ ID NO: 1060 - DNA, 447 bp, Homo sapiens
  TCR 37 - Beta Native
gacagtgacactgatctggtaaagcccccatcctggcctgaccctgccatgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagcttacttctgggggcctatggctacaccttcggttcggggaccaggttaaccgttgta

SEQ ID NO: 1061 - DNA, 513 bp, Homo sapiens
  TCR 38 - Alpha Native
gaggctttgtcgggtggagctgattggttgcaggagcagcaacagttccagagccaagtcatgacaccgacctccccaaggtttagttaaatatatcttatggtgaaaatgcccggagcaagaaggcaaagcatcatgaagaggatattgggagctctgctggggctcttgagtgcccaggtttgctgtgtgagaggaatacaagtggagcagagtcctccagacctgattctccaggagggagccaattccacgctgcggtgcaatttttctgactctgtgaacaatttgcagtggtttcatcaaaacccttggggacagctcatcaacctgttttacattccctcagggacaaaacagaatggaagattaagcgccacgactgtcgctacggaacgctacagcttattgtacatttcctcttcccagaccacagactcaggcgtttatttctgtgctgtggggttcaatgacatgcgctttggagcagggaccagactgacagtaaaacca

SEQ ID NO: 1062 - DNA, 426 bp, Homo sapiens
  TCR 38 - Beta Native
gaggtgcagtgctgcctgccccactgtgccatgggccctgggctcctctgctgggtgctgctttgtctcctgggagcaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcagcttggtagcgggtggagagacccagtacttcgggccaggcacgcggctcctggtgctc

SEQ ID NO: 1063 - DNA, 371 bp, Homo sapiens
  TCR 39 - Alpha Native
gaataatcttgtggatgcagctgacatgggtcagtggtcaacagctgaatcagagtcctcaatctatgtttatccaggaaggagaagatgtctccatgaactgcacttcttcaagcatatttaacacctggctatggtacaagcaggaacctggggaaggtcctgtcctcttgatagccttatataaggctggtgaattgacctcaaatggaagactgactgctcagtttggtataaccagaaaggacagcttcctgaatatctcagcatccatacctagtgatgtaggcatctacttctgtgctggatactcatcttctaacgactacaagctcagctttggagccggaaccacagtaactgtaagagca

SEQ ID NO: 1064 - DNA, 420 bp, Homo sapiens
  TCR 39 - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcacccctagggacaggggcaaggaagctttctttggacaaggcaccagactcacagttgta

SEQ ID NO: 1065 - DNA, 502 bp, Homo sapiens
  TCR 40  - Alpha Native
gctttccaaaatgcacacatctactttccaaaatagaccgcaactatttctattgatctggaagaagcttgtaccaggcaacccatttaggagaagttggatgaagagggagagggagatgctactcatcacatcaatgttggtcttatggatgcaattgtcacaggtgaatggacaacaggtaatgcaaattcctcagtaccagcatgtacaagaaggagaggacttcaccacgtactgcaattcctcaactactttaagcaatatacagtggtataagcaaaggcctggtggacatcccgtttttttgatacagttagtgaagagtggagaagtgaagaagcagaaaagactgacatttcagtttggagaagcaaaaaagaacagctccctgcacatcacagccacccagactacagatgtaggaacctacttctgtgcagggcggaacaacttcaacaaattttactttggatctgggaccaaactcaatgtaaaacca

SEQ ID NO: 1066 - DNA, 417 bp, Homo sapiens
  TCR 40 - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccataacggcccggagctcctacgagcagtacttcgggccgggcaccaggctcacggtcaca

SEQ ID NO: 1067 - DNA, 451 bp, Homo sapiens
  TCR 41  - Alpha Native
gctttttggattgaaaattttaatcctcagtgaaccagggcagaaaagaatgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaccttcgcccttactggaggcttcaaaactatctttggagcaggaacaagactatttgttaaagca

SEQ ID NO: 1068 - DNA, 426 bp, Homo sapiens
  TCR 41  - Beta Native
gctcattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaatccccgggacagggtctcctacgagcagtacttcgggccgggcaccaggctcacggtcaca

SEQ ID NO: 1069 - DNA, 502 bp, Homo sapiens
  TCR  42- Alpha Native
gctttccaaaatgcacacatctactttccaaaatagaccgcaactatttctattgatctggaagaagcttgtaccaggcaacccatttaggagaagttggatgaagagggagagggagatgctactcatcacatcaatgttggtcttatggatgcaattgtcacaggtgaatggacaacaggtaatgcaaattcctcagtaccagcatgtacaagaaggagaggacttcaccacgtactgcaattcctcaactactttaagcaatatacagtggtataagcaaaggcctggtggacatcccgtttttttgatacagttagtgaagagtggagaagtgaagaagcagaaaagactgacatttcagtttggagaagcaaaaaagaacagctccctgcacatcacagccacccagactacagatgtaggaacctacttctgtgcagggccggacaacttcaacaaattttactttggatctgggaccaaactcaatgtaaaacca

SEQ ID NO: 1070 - DNA, 417 bp, Homo sapiens
  TCR 42 - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccaaaacatctcgaagctcctacgagcagtacttcgggccgggcaccaggctcacggtcaca

SEQ ID NO: 1071 - DNA, 508 bp, Homo sapiens
  TCR 43 - Alpha Native
gaaagcagattctttttatgatttttaaagtagaaatatccattccaggtgcattttttaagggtttaaaatttgaatcctcagtgaaccagggcagagaagaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgtccatatactccaatggtgacaaagaagatggaaggtttacagcacagctcaataaagccagccagtatgtttctctgctcatcagagactcccagcccagtgattcagccacctacctctgtgccgtgaacgttcccacctcaggaacctacaaatacatctttggaacaggcaccaggctgaaggttttagca

SEQ ID NO: 1072 - DNA, 420 bp, Homo sapiens
  TCR 43  - Beta Native
gctcattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcaccccccgggacagctacgagcagtacttcgggccgggcaccaggctcacggtcaca

SEQ ID NO: 1073 - DNA, 482 bp, Homo sapiens
  TCR 44 - Alpha Native
ggagtttccttccctcacccacatgaagtgtctaccttctgcagactccaatggctcaggaactgggaatgcagtgccaggctcgtggtatcctgcagcagatgtggggagttttccttctttatgtttccatgaagatgggaggcactacaggacaaaacattgaccagcccactgagatgacagctacggaaggtgccattgtccagatcaactgcacgtaccagacatctgggttcaacgggctgttctggtaccagcaacatgctggcgaagcacccacatttctgtcttacaatgttctggatggtttggaggagaaaggtcgtttttcttcattccttagtcggtctaaagggtacagttacctccttttgaaggagctccagatgaaagactctgcctcttacctctgtgcccaatattctgggggttaccagaaagttacctttggaactggaacaaagctccaagtcatccca

SEQ ID NO: 1074 - DNA, 435 bp, Homo sapiens
  TCR 44 - Beta Native
gagaatgcttactacagagacaccagccccaagctaggagatcctgccatgggcttcaggctcctctgctgtgtggccttttgtctcctgggagcaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcagcgggaccccagatacgcagtattttggcccaggcacccggctgacagtg

SEQ ID NO: 1075 - DNA, 508 bp, Homo sapiens
  TCR 45 - Alpha Native
gctttccaaaatgcacacatctactttccaaaatagaccgcaactatttctattgatctggaagaagcttgtaccaggcaacccatttaggagaagttggatgaagagggagagggagatgctactcatcacatcaatgttggtcttatggatgcaattgtcacaggtgaatggacaacaggtaatgcaaattcctcagtaccagcatgtacaagaaggagaggacttcaccacgtactgcaattcctcaactactttaagcaatatacagtggtataagcaaaggcctggtggacatcccgtttttttgatacagttagtgaagagtggagaagtgaagaagcagaaaagactgacatttcagtttggagaagcaaaaaagaacagctccctgcacatcacagccacccagactacagatgtaggaacctacttctgtgcaggttcctctggggctgggagttaccaactcactttcgggaaggggaccaaactctcggtcatacca

SEQ ID NO: 1076 - DNA, 450 bp, Homo sapiens
  TCR 45 - Beta Native
gacagtgatcctgatctggtaaagctcccatcctgccctgaccctgccatgggcaccaggctcctcttctgggtggccttctgtctcctgggggcatatcacacaggagctggagtctcccagtcccccagtaacaaggtcacagagaagggaaaggatgtagagctcaggtgtgatccaatttcaggtcatactgccctttactggtaccgacagaggctggggcagggcctggagtttttaatttacttccaaggcaacagtgcaccagacaaatcagggctgcccagtgatcgcttctctgcagagaggactggggaatccgtctccactctgacgatccagcgcacacagcaggaggactcggccgtgtatctctgtgccagcagcctttacttggggaccaccggggagctgttttttggagaaggctctaggctgaccgtactg

SEQ ID NO: 1077 - DNA, 524 bp, Homo sapiens
  TCR 46 - Alpha Native
ggaaacttttcaaagccagggacttgtccaatccaacctcctcacagttcctagctcctgaggctcagcgcccttggcttctgtccgcccagctcaaggtcctgcagcattgccactgctcagccatgctcctgctgctcgtcccagcgttccaggtgatttttaccctgggaggaaccagagcccagtctgtgacccagcttgacagccaagtccctgtctttgaagaagcccctgtggagctgaggtgcaactactcatcgtctgtttcagtgtatctcttctggtatgtgcaataccccaaccaaggactccagcttctcctgaagtatttatcaggatccaccctggttaaaggcatcaacggttttgaggctgaatttaacaagagtcaaacttccttccacttgaggaaaccctcagtccatataagcgacacggctgagtacttctgtgctgtgagcccttcctcaggaacctacaaatacatctttggaacaggcaccaggctgaaggttttagca

SEQ ID NO: 1078 - DNA, 449 bp, Homo sapiens
  TCR 46 - Beta Native
acagtgaccctgatctggtaaagctcccatcctgccctgactctgtcatgggcaccaggctcctctgctgggcagccctgtgcctcctgggggcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagcttatatctggggggttcggagacccagtacttcgggccaggcacgcggctcctggtgctc

SEQ ID NO: 1079 - DNA, 509 bp, Homo sapiens
  TCR 47 - Alpha Native
gaaaagcagattctttttatgatttttaaagtagaaatatccattctaggtgcattttttaagggtttaaaatttgaatcctcagtgaaccagggcagagaagaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacctgctttcgggttctgcaaggcaactgacctttggatctgggacacaattgactgttttacct

SEQ ID NO: 1080 - DNA, 420 bp, Homo sapiens
  TCR 47 - Beta Native
gctcattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccatgacagggcggactacctacgagcagtacttcgggccgggcaccaggctcacggtcaca

SEQ ID NO: 1081 - DNA, 507 bp, Homo sapiens
  TCR 48 - Alpha Native
aggacagatttcttttatgattcctacagcagaaaaatgagaaacgtttgttattatttttttttcgtgtttaaggtttgaatcctcagtgaaccagggcagaaaagaatgatgaaatccttgagagttttactggtgatcctgtggcttcagttaagctgggtttggagccaacagaaggaggtggagcaggatcctggaccactcagtgttccagagggagccattgtttctctcaactgcacttacagcaacagtgcttttcaatacttcatgtggtacagacagtattccagaaaaggccctgagttgctgatgtacacatactccagtggtaacaaagaagatggaaggtttacagcacaggtcgataaatccagcaagtatatctccttgttcatcagagactcacagcccagtgattcagccacctacctctgtgcaatgcggattcagggagcccagaagctggtatttggccaaggaaccaggctgactatcaaccca

SEQ ID NO: 1082 - DNA, 420 bp, Homo sapiens
  TCR 48 - Beta Native
gctcattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcacaggcagggtctcctacgagcagtacttcgggccgggcaccaggctcacggtcaca

SEQ ID NO: 1083 - DNA, 508 bp, Homo sapiens
  TCR 49 - Alpha Native
gaaagcagattctttttatgatttttaaagtagaaatatccattctaggtgcattttttaagggtttaaaatttgaatcctcagtgaaccagggcagagaagaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacatagggacctcaggaacctacaaatacatctttggaacaggcaccaggctgaaggttttagca

SEQ ID NO: 1084 - DNA, 417 bp, Homo sapiens
  TCR 49 - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcactccaaggtattcctacgagcagtacttcgggccgggcaccaggctcacggtcaca

SEQ ID NO: 1085 - DNA, 419 bp, Homo sapiens
  TCR 50 - Alpha Native
ggcaggtcccagtggggagaacaatgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagagtccccctggaacctacaaatacatctttggaacaggcaccaggctgaaggttttagca

SEQ ID NO: 1086 - DNA, 421 bp, Homo sapiens
  TCR 50 - Beta Native
gagccccaagctaggagatcctgccatgggcttcaggctcctctgctgtgtggccttttgtctcctgggagcaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcactattataatggagaagagagagcaaaaggaaacattcttgaacgattctccgcacaacagttccctgacttgcactctgaactaaacctgagctctctggagctgggggactcagctttgtatttctgtgccagcagcgccaccagggacgcctatggctacaccttcggttcggggaccaggttaaccgttgta

SEQ ID NO: 1087 - DNA, 511 bp, Homo sapiens
  TCR 51 - Alpha Native
gaaagcagattctttttatgatttttaaagtagaaatatccattccaggtgcattttttaagggtttaaaatttgaatcctcagtgaaccagggcagagaagaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgtccatatactccaatggtgacaaagaagatggaaggtttacagcacagctcaataaagccagccagtatgtttctctgctcatcagagactcccagcccagtgattcagccacctacctctgtgccgtgaacatgagaggtggaggtagcaactataaactgacatttggaaaaggaactctcttaaccgtgaatcca

SEQ ID NO: 1088 - DNA, 417 bp, Homo sapiens
  TCR 51 - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccatcgctagtagggtatcctacgagcagtacttcgggccgggcaccaggctcacggtcaca

SEQ ID NO: 1089 - DNA, 467 bp, Homo sapiens
  TCR 52 - Alpha Native
gagcccagagaagtctgttccaggacgggctctttcaggagcagctaaagtcaggggccatgtccaccatgtgatagaaagacaagatggtcctgaaattctccgtgtccattctttggattcagttggcatgggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagcctggtgatacaggcctctacctctgtgcaggagcgagggactacaagctcagctttggagccggaaccacagtaactgtaagagca

SEQ ID NO: 1090 - DNA, 421 bp, Homo sapiens
  TCR 52 - Beta Native
gagccccaagctaggagatcctgccatgggcttcaggctcctctgctgtgtggccttttgtctcctgggagcaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcagcgtaggggacttaaacaatgagcagttcttcgggccagggacacggctcaccgtgcta

SEQ ID NO: 1091 - DNA, 416 bp, Homo sapiens
  TCR  53- Alpha Native
gcttagctggagccatggcctctgcacccatctcgatgcttgcgatgctcttcacattgagtgggctgagagctcagtcagtggctcagccggaagatcaggtcaacgttgctgaagggaatcctctgactgtgaaatgcacctattcagtctctggaaacccttatcttttttggtatgttcaataccccaaccgaggcctccagttccttctgaaatacatcacaggggataacctggttaaaggcagctatggctttgaagctgaatttaacaagagccaaacctccttccacctgaagaaaccatctgcccttgtgagcgactccgctttgtacttctgtgctgtgagagactttggctcaggaacctacaaatacatctttggaacaggcaccaggctgaaggttttagca

SEQ ID NO: 1092 - DNA, 453 bp, Homo sapiens
  TCR 53 - Beta Native
gacagtgacactgatctggtaaagccctcatcctgtcctgaccctgccatgggcaccagtctcctatgctgggtggtcctgggtttcctagggacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagcggctccgggactagcggctacaatgagcagttcttcgggccagggacacggctcaccgtgcta

SEQ ID NO: 1093 - DNA, 440 bp, Homo sapiens
  TCR 54 - Alpha Native
gaagtcaacttctgggagcagatctctgcagaataaaaatgaaaaagcatctgacgaccttcttggtgattttgtggctttatttttatagggggaatggcaaaaaccaagtggagcagagtcctcagtccctgatcatcctggagggaaagaactgcactcttcaatgcaattatacagtgagccccttcagcaacttaaggtggtataagcaagatactgggagaggtcctgtttccctgacaatcatgactttcagtgagaacacaaagtcgaacggaagatatacagcaactctggatgcagacacaaagcaaagctctctgcacatcacagcctcccagctcagcgattcagcctcctacatctgtgtggtgagccgggataactatggtcagaattttgtctttggtcccggaaccagattgtccgtgctgccc

SEQ ID NO: 1094 - DNA, 417 bp, Homo sapiens
  TCR 54 - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccattacagaccgcactaactatggctacaccttcggttcggggaccaggttaaccgttgta

SEQ ID NO: 1095 - DNA, 507 bp, Homo sapiens
  TCR 55 - Alpha Native
gagatgcctctgtggacagtttaagaaaccacagtgctttggaggaaaggaagagatacttgataatatagctctcttggctggagattgcaggtcccagtggggagaacaatgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagtcccctcgggtgctacaaacaagctcatctttggaactggcactctgcttgctgtccagcca

SEQ ID NO: 1096 - DNA, 66 bp, Artificial Sequence
  TCR 50/ TCR 54 P2A
ggcagcggcgccaccaacttcagcctgcttaaacaggcaggcgacgtggaggagaatcctggccca

SEQ ID NO: 1097 - DNA, 402 bp, Homo sapiens
  TCR 15 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgaagcctggcggctacaacaagctgatcttcggagccggcaccagactggccgtgcaccct

SEQ ID NO: 1098 - DNA, 402 bp, Homo sapiens
  TCR 15 Codon-optimized/ cysteine-modified beta
atggacagctggaccttttgctgcgtgtccctgtgcatcctggtggccaagcacaccgatgccggcgtgatccagagccccagacacgaagtgaccgagatgggccaggaagtgaccctgcgctgcaagcccatcagcggccacaacagcctgttctggtacagacagaccatgatgcggggcctggaactgctgatctacttcaacaacaacgtgcccatcgacgacagcggcatgcccgaggacagattcagcgccaagatgcccaacgccagcttcagcaccctgaagatccagcccagcgagcccagagacagcgccgtgtacttttgcgccagcagcctcgtgggcagaagccggaccgagcagtactttggccctggcaccagactgaccgtgacc

SEQ ID NO: 1099 - DNA, 393 bp, Homo sapiens
  TCR 16 Codon-optimized/ cysteine-modified alpha
atggaaaccctgctgggcctgctgatcctgtggctgcagctccagtgggtgtccagcaagcaggaagtgacccagatccctgccgccctgtctgtgcctgagggcgagaacctggtgctgaactgcagcttcaccgacagcgccatctacaacctgcagtggttccggcaggaccccggcaagggactgacaagcctgctgctgattcagagcagccagagagagcagaccagcggcagactgaacgccagcctggacaagtcctccggcagaagcaccctgtatatcgccgcctcccagcctggcgatagcgccacatatctgtgtgccgtgcggcctgccaacaacaacgacatgagattcggagccggcacccggctgaccgtgaagcct

SEQ ID NO: 1100 - DNA, 399 bp, Homo sapiens
  TCR 16 Codon-optimized/ cysteine-modified beta
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcctgtggggcagaagcaaccagcctcagcacttcggcgacggcaccagactgagcatcctc

SEQ ID NO: 1101 - DNA, 402 bp, Homo sapiens
  TCR 17 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccccagctacggcctgttctggtacaagcagcccagcagcggcgagatgatcttcctgatctaccagggcagctacgaccagcagaacgccaccgagggccggtacagcctgaacttccagaaggcccggaagtccgccaacctggtcatctctgccagccagctgggcgacagcgccatgtacttttgcgccatgagagagggcagaggcgacaagatcattttcggcaagggcacccggctgcacatcctgccc

SEQ ID NO: 1102 - DNA, 399 bp, Homo sapiens; identical to SEQ ID NO: 1100
  TCR 17 Codon-optimized/ cysteine-modified beta

SEQ ID NO: 1103 - DNA, 402 bp, Homo sapiens
  TCR 18 Codon-optimized/ cysteine-modified alpha
atggaaaccctgctgggcctgctgatcctgtggctgcagctccagtgggtgtccagcaagcaggaagtgacccagatccctgccgccctgtctgtgcctgagggcgagaacctggtgctgaactgcagcttcaccgacagcgccatctacaacctgcagtggttccggcaggaccccggcaagggactgacaagcctgctgctgattcagagcagccagagagagcagaccagcggcagactgaacgccagcctggacaagtcctccggcagaagcaccctgtatatcgccgcctcccagcctggcgatagcgccacatatctgtgcgccgagggcaatgccggcggaaccagctacggcaagctgacctttggccagggcaccatcctgaccgtgcacccc

SEQ ID NO: 1104 - DNA, 399 bp, Homo sapiens
  TCR 18 Codon-optimized/ cysteine-modified beta
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcttctggggcagaagcaacagccctctgcacttcggcaacggcaccagactgaccgtgacc

SEQ ID NO: 1105 - DNA, 408 bp, Homo sapiens
  TCR 19 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagagagaacaccggcaccgccagcaagctgaccttcggcacaggcaccagactgcaggtcacactg

SEQ ID NO: 1106 - DNA, 399 bp, Homo sapiens
  TCR 19 Codon-optimized/ cysteine-modified beta
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcagctggggccagagcacaggcgagcagtactttggccctggcaccagactgaccgtgacc

SEQ ID NO: 1107 - DNA, 405 bp, Homo sapiens
  TCR 20 Codon-optimized/ cysteine-modified alpha
atgaacatgctgaccgccagcctgctgagagccgtgatcgccagcatctgcgtggtgtccagcatggcccagaaagtgacccaggcccagaccgagatcagcgtggtggaaaaagaagatgtgaccctggactgcgtgtacgagacacgggacaccacctactacctgttctggtacaagcagcctcccagcggcgagctggtgttcctgatcagacggaacagcttcgacgagcagaacgagattagcggccggtacagctggaacttccagaagtccaccagcagcttcaacttcaccatcaccgcctcccaggtggtggacagcgccgtgtacttttgtgccctgtggaccggggccaacaacctgttctttggcaccggaacccggctgaccgtgatcccc

SEQ ID NO: 1108 - DNA, 393 bp, Homo sapiens
  TCR 20 Codon-optimized/ cysteine-modified beta
atgctgctgctcctgctcctcctgggacctggatctggactgggagccgtggtgtcccagcaccccagcagagtgatctgcaagagcggcaccagcgtgaagatcgagtgcagaagcctggacttccaggccaccaccatgttctggtacagacagttccccaagcagagcctgatgctgatggccacctccaacgagggcagcaaggccacatacgagcagggcgtggaaaaggacaagttcctgatcaaccacgccagcctgaccctgagcaccctgacagtgacaagcgcccaccccgaggacagcagcttctacatctgtagcgccagcagcctggccagaagaagctacgagcagtacttcggccctggcaccagactgaccgtgacc

SEQ ID NO: 1109 - DNA, 414 bp, Homo sapiens
  TCR 21 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgcgcgagggcagagtgaccggcggaggcaacaagctgacctttggcaccggcacccagctgaaagtggaactg

SEQ ID NO: 1110 - DNA, 441 bp, Homo sapiens
  TCR 21 Codon-optimized/ cysteine-modified beta
atgcacagacctagaaggcccctgcatcccgtggcccctgccatgtctatcggcctgctgtgctgcgtggcattctccctgctgtgggcctctcctgtgaatgccggcgtgacccagacccctaagttccaggtgctgaaaaccggccagagcatgaccctgcagtgcgcccaggacatgaaccacaacagcatgtactggtacagacaggaccccggcatgggcctgcggctgatctactatagcgccagcgagggcaccaccgacaagggcgaggtgcccaacggctacaacgtgtcccggctgaacaagagagagttcagcctgagactggaaagcgccgctcccagccagaccagcgtgtacttctgtgccagcagaccctggggcaaccagaacaccgaggcattctttgggcagggcacccggctgacagtggtc

SEQ ID NO: 1111 - DNA, 438 bp, Homo sapiens
  TCR 22 Codon-optimized/ cysteine-modified alpha
atggcccaggaactgggcatgcagtgtcaggccagaggcatcctgcagcagatgtggggcgtgttcctgctgtacgtgtccatgaagatgggcggcaccaccggccagaacatcgaccagcctaccgagatgaccgccaccgagggcgctatcgtgcagatcaactgcacctaccagaccagcggcttcaacggcctgttctggtatcagcagcacgccggcgaggcccctaccttcctgagctacaatgtgctggacggcctggaagagaagggccggttcagcagcttcctgtccagaagcaagggctacagctacctgctgctgaaagaactgcagatgaaggacagcgcctcctacctgtgtgccgtgcgggccagaatggacagcaactaccagctgatctggggagccggcaccaagctgatcatcaagccc

SEQ ID NO: 1112 - DNA, 393 bp, Homo sapiens
  TCR 22 Codon-optimized/ cysteine-modified beta
atgggacctggactgctgtgctgggtgctgctgtgtctgctgggagccggacctgtggatgccggcgtgacacagagccccacccacctgatcaagaccagaggccagcacgtgaccctgcggtgtagccctatcagcggccacaagagcgtgtcctggtatcagcaggtcctgggccagggccctcagttcatcttccagtactacgagaaagaggaacgcggcagaggcaacttccccgacagattcagcgccagacagttccccaactacagcagcgagctgaacgtgaacgccctgctgctgggcgatagcgccctgtacctgtgtgccagcagccggaccgagaactacggctacaccttcggcagcggcaccagactgacagtggtc

SEQ ID NO: 1113 - DNA, 408 bp, Homo sapiens
  TCR 23 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagcccacctggcggcagcgccagacagctgacatttggctctggcacccagctgaccgtgctgccc

SEQ ID NO: 1114 - DNA, 399 bp, Homo sapiens
  TCR 23 Codon-optimized/ cysteine-modified beta
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcccctggggccagtctaatcagcctcagcacttcggcgacggcacccggctgtctattctc

SEQ ID NO: 1115 - DNA, 411 bp, Homo sapiens
  TCR 24 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagagagggcagaggcgacagctggggcaagctgcagtttggagccggcacccaggtggtcgtgacccct

SEQ ID NO: 1116 - DNA, 399 bp, Homo sapiens
  TCR 24 Codon-optimized/ cysteine-modified beta
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagccctttcggcagaggcagctacgagcagtacttcggccctggcaccagactgaccgtgacc

SEQ ID NO: 1117 - DNA, 414 bp, Homo sapiens
  TCR 25 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgagagagggcagcctgaccggcggaggcaacaagctgacctttggcaccggcacccagctgaaagtggaactg

SEQ ID NO: 1118 - DNA, 399 bp, Homo sapiens
  TCR 25 Codon-optimized/ cysteine-modified beta
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcctgtggggccagagcaatcagcctcagcacttcggcgacggcacccggctgtctattctc

SEQ ID NO: 1119 - DNA, 402 bp, Homo sapiens
  TCR 26 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgcgggacgcccggaacaacgacatgagattcggagccggcacccggctgaccgtgaagcct

SEQ ID NO: 1120 - DNA, 399 bp, Homo sapiens
  TCR 26 Codon-optimized/ cysteine-modified beta
atgtctctgggactgctgtgctgcggagccttctctctgctgtgggccggacctgtgaatgccggcgtgacccagacccctaagttccgggtgctgaaaaccggccagagcatgaccctgctgtgcgcccaggacatgaaccacgagtacatgtattggtacagacaggaccccggcatgggcctgcggctgatccactattctgtgggcgagggcaccaccgccaagggcgaagtgcctgacggctacaacgtgtcccggctgaagaagcagaacttcctgctgggcctggaaagcgccgctcctagccagaccagcgtgtacttctgcgccagcagctactacgccagcggccggaactacgagcagtacttcggccctggcacccggctgacagtg

SEQ ID NO: 1121 - DNA, 393 bp, Homo sapiens
  TCR 27 Codon-optimized/ cysteine-modified alpha
atgaagctggtcaccagcatcaccgtgctgctgagcctgggaatcatgggcgacgccaagaccacccagcccaacagcatggaaagcaacgaagaggaacccgtgcatctgccctgcaaccacagcaccatcagcggcaccgactacatccactggtacagacagctgcccagccagggccccgagtatgtgatccacggcctgaccagcaacgtgaacaaccggatggcctccctggccattgccgaggacagaaagagcagcaccctgatcctgcaccgggccacactgagagatgccgccgtgtactactgcatcctgcgggtgccacctcagagcggcggctaccagaaagtgaccttcggcaccggcaccaagctgcaggtcatcccc

SEQ ID NO: 1122 - DNA, 441 bp, Homo sapiens
  TCR 27 Codon-optimized/ cysteine-modified beta
atgcacagacctagaaggcccctgcatcccgtggcccctgccatgtctatcggcctgctgtgctgcgtggcattctccctgctgtgggcctctcctgtgaatgccggcgtgacccagacccctaagttccaggtgctgaaaaccggccagagcatgaccctgcagtgcgcccaggacatgaaccacaacagcatgtactggtacagacaggaccccggcatgggcctgcggctgatctactatagcgccagcgagggcaccaccgacaagggcgaggtgcccaacggctacaacgtgtcccggctgaacaagagagagttcagcctgagactggaaagcgccgctcccagccagaccagcgtgtacttttgcgccagcagcgagttcggcagcctgaacgagaagctgttcttcggcagcggcacccagctgagcgtgctc

SEQ ID NO: 1123 - DNA, 402 bp, Homo sapiens
  TCR 28 Codon-optimized/ cysteine-modified alpha
atgatgatcagcctgcgggtgctgctggtcatcctgtggctgcagctgagctgggtctggtcccagcggaaagaggtggaacaggaccctggccccttcaacgtgccagagggcgctaccgtggccttcaactgcacctacagcaacagcgccagccagagcttcttctggtacagacaggactgccggaaagaacccaagctgctgatgagcgtgtacagcagcggcaacgaggacggcagattcaccgcccagctgaaccgggccagccagtacatctccctgctgatccgggacagcaagctgagcgacagcgccacctatctgtgtgtcgtgcggggaggcggcaccagctacggcaagctgacatttggccagggcaccatcctgaccgtgcacccc

SEQ ID NO: 1124 - DNA, 402 bp, Homo sapiens
  TCR 28 Codon-optimized/ cysteine-modified beta
atgggcatcagactgctgtgcagagtggccttctgcttcctggccgtgggcctggtggacgtgaaagtgacccagagcagcagatacctggtcaagcggaccggcgagaaggtgttcctggaatgcgtgcaggacatggaccacgagaatatgttctggtacagacaggaccccggcctgggcctgcggctgatctacttcagctacgacgtgaagatgaaggaaaagggcgacatccccgagggctacagcgtgtccagagagaagaaagagcggttcagcctgatcctggaaagcgccagcaccaaccagaccagcatgtacctgtgcgccagcagcctgtggggcagaagcagcggcaacaccatctacttcggcgagggcagctggctgaccgtggtc

SEQ ID NO: 1125 - DNA, 408 bp, Homo sapiens
  TCR 29 Codon-optimized/ cysteine-modified alpha
atgagcctgagcagcctgctgaaggtggtcaccgcttctctgtggctgggccctggaatcgcccagaagatcacccagacccagcccggcatgttcgtgcaggaaaaagaggccgtcaccctggactgcacctacgacaccagcgaccagagctacggcctgttctggtacaagcagcccagcagcggcgagatgatcttcctgatctaccagggcagctacgacgagcagaacgccaccgagggccggtacagcctgaacttccagaaggcccggaagtccgccaacctggtcatctctgccagccagctgggcgacagcgccatgtacttttgcgccatgcggctgaacaccggcaccgccagcaagctgaccttcggcacaggcaccagactgcaggtcacactg

SEQ ID NO: 1126 - DNA, 399 bp, Homo sapiens
  TCR 29 Codon-optimized/ cysteine-modified beta
atgagcaatcaggtgctgtgctgcgtggtcctgtgcctgctgggagccaataccgtggatggcggcatcacccagagccccaagtacctgttccggaaagagggccagaacgtcaccctgagctgcgagcagaacctgaaccacgacgccatgtactggtacagacaggaccccggccagggcctgcggctgatctactacagccagatcgtgaacgacttccagaagggcgacattgccgagggctacagcgtgtccagagagaagaaagagtccttcccactgaccgtgaccagcgcccagaagaaccccaccgccttctacctgtgtgccagctctccttggggcagagccaccaacgagcagttcttcggccctggcaccaggctgacagtgctg

SEQ ID NO: 1127 - DNA, 393 bp, Homo sapiens
  TCR 30 Codon-optimized/ cysteine-modified alpha
atgcggctggtggccagagtgaccgtgttcctgaccttcggcaccatcatcgacgccaagaccacccagcctcccagcatggattgtgccgagggcagagccgccaacctgccctgcaatcacagcaccatcagcggcaacgagtacgtgtactggtacagacagatccacagccagggccctcagtacatcatccacggcctgaagaacaacgagacaaacgagatggccagcctgatcatcaccgaggacagaaagagcagcaccctgatcctgccccacgccaccctgagagacaccgccgtgtactactgtatcgtgcggggcacaagcgtgctgcagggcaacgagaagctgacatttggcaccggcacccggctgaccatcatcccc

SEQ ID NO: 1128 - DNA, 402 bp, Homo sapiens
  TCR 30 Codon-optimized/ cysteine-modified beta
atggatacctggctcgtgtgctgggccatcttcagcctgctgaaggccggactgaccgagcccgaagtgacccagacacccagccaccaggtcacacagatgggccaggaagtgatcctgcgctgcgtgcccatcagcaaccacctgtacttctactggtacagacagatcctgggccagaaggtggaattcctcgtcagcttctacaacaacgagatcagcgagaagtccgagattttcgacgaccagttcagcgtggaacggcccgacggcagcaacttcaccctgaagatcagaagcaccaagctcgaggacagcgccatgtacttttgcgccagcagcagacagcccagcagcggcaacaccatctacttcggcgagggcagctggctgaccgtggtc

SEQ ID NO: 1129 - DNA, 414 bp, Homo sapiens
  TCR 31 Codon-optimized/ cysteine-modified alpha
atggccatgctgctgggagcctctgtgctgatcctgtggctccagcccgactgggtcaacagccagcagaagaacgacgaccagcaggtcaaacagaacagccccagcctgagcgtgcaggaaggccggatcagcatcctgaactgcgactacaccaacagcatgttcgactactttctgtggtacaagaagtaccccgccgagggccccaccttcctgatctccatcagcagcatcaaggacaagaacgaggacggccggttcaccgtgtttctgaacaagagcgccaagcacctgagcctgcacatcgtgcctagccagcctggcgacagcgccgtgtacttttgtgccgccagcgagcggggcacctacaagtacatcttcggcaccggcacccggctgaaggtgctggct

SEQ ID NO: 1130 - DNA, 402 bp, Homo sapiens
  TCR 31 Codon-optimized/ cysteine-modified beta
atgggcaccagactgctgttctgggtggccttctgcctgctgggagccgatcatacaggtgccggcgtgtcccagagccccagcaacaaagtgaccgagaagggcaaggacgtggaactgagatgcgaccccatcagcggccacaccgccctgtactggtacagacagtctctgggccagggcctggaattcctgatctattttcagggcaacagcgcccctgacaagagcggcctgcccagcgatagattcagcgccgagagaacaggcggcagcgtgtccaccctgaccatccagagaacccagcaggaagatagcgccgtctacctgtgcgccagcagcagattcctgggcagcaccgacacccagtacttcggcccaggcaccaggctgacagtgctg

SEQ ID NO: 1131 - DNA, 381 bp, Homo sapiens
  TCR 32 Codon-optimized/ cysteine-modified alpha
atggtgctgaagttcagcgtgtccatcctgtggatccagctggcctgggtgtccacccagctgctggaacagagccctcagttcctgagcatccaggaaggcgagaacctgaccgtgtactgcaacagcagcagcgtgttcagcagcctgcagtggtacagacaggaacccggcgagggacctgtgctgctggtcacagtcgtgacaggcggcgaagtgaagaagctgaagcggctgaccttccagttcggcgacgccagaaaggacagctccctgcacattacagccgcccagcctggcgataccggcctgtatctgtgtgccggcggaagcaactacaagctgacctttggcaagggcaccctgctgaccgtgaacccc

SEQ ID NO: 1132 - DNA, 399 bp, Homo sapiens
  TCR 32 Codon-optimized/ cysteine-modified beta
atgggcttcagactgctgtgctgcgtggccttctgtctgctgggagccggacctgtggatagcggcgtgacccagacccctaagcacctgatcaccgccaccggccagcgcgtgacactgagatgtagccctagaagcggcgacctgagcgtgtactggtatcagcagagcctggaccagggcctgcagttcctgatccagtactacaacggcgaggaacgggccaagggcaacatcctggaacggttcagcgcccagcagttccccgatctgcacagcgagctgaacctgagcagcctggaactgggcgacagcgccctgtacttctgtgcctcttctgtgggcggcgaccacagcgacgagcagttttttggccctggcacccggctgaccgtgctg

SEQ ID NO: 1133 - DNA, 405 bp, Homo sapiens
  TCR 33 Codon-optimized/ cysteine-modified alpha
atgatgaagtccctgcgggtgctgctggtcatcctgtggctgcagctgagctgggtctggtcccagcagaaagaggtggaacagaacagcggcccactgagcgtgccagagggcgctatcgccagcctgaactgcacctacagcgaccggggcagccagagcttcttctggtacagacagtacagcggcaagagccccgagctgatcatgttcatctacagcaacggcgacaaagaggacggccggttcaccgcccagctgaacaaggccagccagtacgtgtccctgctgatcagagacagccagcccagcgacagcgccacctacctgtgtgccgtgaatgcccaccacaccggcggcttcaagaccatctttggagccggcacccggctgttcgtgaaggcc

SEQ ID NO: 1134 - DNA, 396 bp, Homo sapiens
  TCR 33 Codon-optimized/ cysteine-modified beta
atggatacctggctcgtgtgctgggccatcttcagcctgctgaaggccggactgaccgagcccgaagtgacccagacacccagccaccaggtcacacagatgggccaggaagtgatcctgcgctgcgtgcccatcagcaaccacctgtacttctactggtacagacagatcctgggccagaaggtggaattcctcgtcagcttctacaacaacgagatcagcgagaagtccgagattttcgacgaccagttcagcgtggaacggcccgacggcagcaacttcaccctgaagatcagaagcaccaagctcgaggacagcgccatgtacttttgcgccagcacccctcgggacacctacgagcagtacttcggccctggcaccagactgaccgtgacc

SEQ ID NO: 1135 - DNA, 381 bp, Homo sapiens
  TCR 34 Codon-optimized/ cysteine-modified alpha
atgaagaaactgctggccatgatcctgtggctgcagctggacagactgagcggcgagctgaaggtggaacagaaccctctgttcctgagcatgcaggaaggcaagaactacaccatctactgcaactacagcaccaccagcgaccggctgtactggtacagacaggaccccggcaagagcctggaaagcctgttcgtgctgctgagcaacggggccgtgaagcaggaaggacggctgatggccagcctggacaccaaggccagactgtccaccctgcacatcacagccgccgtgcacgacctgagcgccacctacttttgtgccgtgtccggcacctacaagtacatcttcggcaccggcaccagactgaaggtgctggcc

SEQ ID NO: 1136 - DNA, 396 bp, Homo sapiens
  TCR 34 Codon-optimized/ cysteine-modified beta
atgggacctggactgctgtgttgggccctgctgtgtctgctgggagccggatctgtggaaaccggcgtgacccagagccccacccacctgatcaagaccagaggccagcaggtcacactgcggtgtagcagccagagcggccacaacaccgtgtcctggtatcagcaggccctgggccagggaccccagttcatcttccagtactaccgcgaggaagagaacggcagaggcaacttcccaccccggttcagcggcctgcagttccccaattacagcagcgagctgaacgtgaacgccctggaactggacgacagcgccctgtacctgtgcgcctctagcagctacgccggcagctacgagcagtacttcggccctggcaccagactgaccgtgacc

SEQ ID NO: 1137 - DNA, 387 bp, Homo sapiens
  TCR 35 Codon-optimized/ cysteine-modified alpha
atggctctgcagtctacactgggagctgtgtggctgggcctgctgctgaattctctgtggaaggtggccgagagcaaggaccaggtgttccagccttctacagtggcctcttctgagggcgccgtggtggaaatcttctgcaaccacagcgtgtccaacgcctacaacttcttctggtatctgcacttccccggctgcgcccctagactgcttgtgaagggaagcaagcctagccagcagggcagatacaacatgacctacgagcggttcagcagctccctgctgattctgcaagtgcgggaagccgatgccgccgtgtattattgtgctgtggccggcgactacaagctgagctttggagccggcaccacagtgacagtgcgggct

SEQ ID NO: 1138 - DNA, 402 bp, Homo sapiens
  TCR 35 Codon-optimized/ cysteine-modified beta
atgggctttagactgctgtgctgcgtggccttctgtctgcttggagctggccctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccagtactacaacggcgaggaaagagccaagggcaacatcctggaacggttcagcgcccagcagttcccagatctgcacagcgagctgaacctgagcagcctggaactgggagatagcgccctgtacttctgtgccagcaccacaagcggcgatagcagctacaacgagcagttcttcggccctggcaccagactgacagttctg

SEQ ID NO: 1139 - DNA, 399 bp, Homo sapiens
  TCR 36 Codon-optimized/ cysteine-modified alpha
atgatgatcagcctgcgggtgctgctggtcatcctgtggctgcaactgagctgggtctggtcccagcggaaagaggtggaacaggaccccggacctttcaatgtgcctgaaggcgccaccgtggccttcaactgcacctacagcaatagcgccagccagagcttcttctggtacagacaggactgccggaaagaacccaagctgctgatgagcgtgtacagcagcggcaacgaggacggcagattcacagcccagctgaacagagccagccagtacatctccctgctgatccgggatagcaagctgagcgatagcgccacctacctgtgcgtggtcaacagagacaactacggccagaacttcgtgttcggccctggcacaagactgagcgtgctgcct

SEQ ID NO: 1140 - DNA, 396 bp, Homo sapiens
  TCR 36 Codon-optimized/ cysteine-modified beta
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatgaccggcagaagcaactacgagcagtacttcggccctggcaccagactgacagtgaca

SEQ ID NO: 1141 - DNA, 390 bp, Homo sapiens
  TCR 37 Codon-optimized/ cysteine-modified alpha
atgaagaaactgctggccatgatcctgtggctgcagctggatagactgagcggcgagctgaaggtggaacagaaccctctgttcctgagcatgcaagagggcaagaactacaccatctactgcaactacagcaccaccagcgaccggctgtactggtacagacaggatccaggcaagagcctggaaagcctgttcgtgctgctgagcaatggcgccgtgaaacaagagggtagactgatggccagcctggacaccaaggccagactgagcacactgcacattacagccgccgtgcacgatctgagcgccacctatttttgtgccggctactctggcgccggaagctaccagctgacatttggcaagggcaccaagctgagcgtgatcccc

SEQ ID NO: 1142 - DNA, 399 bp, Homo sapiens
  TCR 37 Codon-optimized/ cysteine-modified beta
atgggaacaagactgctgtgttgggtcgtgctgggcttcctgggcacagatcatacaggtgccggtgtctctcagagccccagatacaaggtggccaagcgcggacaggatgtggccctgagatgtgatcctatcagcggccacgtgtccctgttctggtatcagcaggctctcggacagggccccgagttcctgacctactttcagaatgaggcccagctggacaagagcggcctgcctagcgatagattcttcgccgaaagacccgagggcagcgtgtccacactgaagatccagagaacccagcaagaggacagcgccgtgtacctgtgtgcctctagtctgctgctgggcgcctacggctacacatttggctctggcaccagactgaccgtggtc

SEQ ID NO: 1143 - DNA, 414 bp, Homo sapiens
  TCR 38 Codon-optimized/ cysteine-modified alpha
atggtcaagatgcctggcgctagacggcagagcatcatgaagagaattctgggcgccctgctgggcctgctgtctgcccaagtttgttgtgtgcggggcatccaggtggaacagagccctcctgatctgatcctgcaagagggcgccaacagcaccctgagatgcaacttcagcgacagcgtgaacaacctgcagtggttccaccagaatccttggggccagctgatcaacctgttctacatccccagcggcaccaagcagaacggcagactgtctgctaccaccgtggccaccgagagatacagcctgctgtacatcagcagcagccagaccacagacagcggcgtgtacttttgcgccgtgggcttcaacgacatgagattcggagccggcaccagactgaccgtgaagcct

SEQ ID NO: 1144 - DNA, 396 bp, Homo sapiens
  TCR 38 Codon-optimized/ cysteine-modified beta
atgggacctggactgctttgttgggtgctgctgtgtctgctcggagccggatctgtggaaacaggcgtgacacagagccccacacacctgatcaagaccagaggccagcaagtgaccctgagatgcagctctcagagcggccacaataccgtgtcctggtatcagcaggccctcggacagggccctcagttcatcttccagtactacagagaggaagagaacggcagaggcaacttcccacctagattcagcggcctgcagttccccaactacagcagcgagctgaacgtgaacgccctggaactggatgacagcgccctgtacctgtgtgcctcttctcttgtggctggcggcgagacacagtactttggccccggaacaagactgctggtgctg

SEQ ID NO: 1145 - DNA, 357 bp, Homo sapiens
  TCR 39 Codon-optimized/ cysteine-modified alpha
atgcagctgacatgggtttccggccagcagctgaatcagagccctcagagcatgttcatccaagaaggcgaggacgtttccatgaactgcaccagcagcagcatcttcaacacctggctgtggtacaagcaagagcctggcgaaggacccgtgctgctgatcgctctttacaaggccggcgagctgaccagcaacggcagactgacagcccagttcggcattacccggaaggacagcttcctgaacatcagcgccagcattcccagcgacgtgggcatctatttctgcgccggctacagcagctccaacgactacaagctgagcttcggagccggcaccaccgtgacagttagagcc

SEQ ID NO: 1146 - DNA, 399 bp, Homo sapiens
  TCR 39 Codon-optimized/ cysteine-modified alpha
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcacacccagagacagaggcaaagaggccttcttcggccaaggcaccagactgacagtggtc

SEQ ID NO: 1147 - DNA, 492 bp, Homo sapiens
  TCR 40 Codon-optimized/ cysteine-modified alpha
atgcacaccagcaccttccagaacagaccccagctgttcctgctgatctggaagaaactggtgcccggcaatcccttcaggcggtcttggatgaagcgcgagagagagatgctgctgatcacctccatgctggtgctgtggatgcagctgagccaagtgaacggccagcaagtgatgcagatccctcagtaccagcacgtgcaagaaggcgaggacttcaccacctactgcaacagcagcaccacactgagcaacatccagtggtacaagcagcggcctggcggacaccctgtgtttctgatccagctggtcaagtccggcgaagtgaagaagcagaagcggctgaccttccagttcggcgaggccaagaagaacagcagcctgcacatcaccgccacacagaccaccgatgtgggcacctacttttgcgccggcagaaacaacttcaacaagttctacttcggcagcggcaccaagctgaacgtgaagccc

SEQ ID NO: 1148 - DNA, 396 bp, Homo sapiens
  TCR 40 Codon-optimized/ cysteine-modified beta
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatcaccgccagaagcagctacgagcagtatttcggccctggcaccagactgaccgtgaca

SEQ ID NO: 1149 - DNA, 402 bp, Homo sapiens
  TCR 41 Codon-optimized/ cysteine-modified alpha
atgatgatcagcctgcgggtgctgctggtcatcctgtggctgcaactgagctgggtctggtcccagcggaaagaggtggaacaggaccccggacctttcaatgtgcctgaaggcgccaccgtggccttcaactgcacctacagcaatagcgccagccagagcttcttctggtacagacaggactgccggaaagaacccaagctgctgatgagcgtgtacagcagcggcaacgaggacggcagattcacagcccagctgaacagagccagccagtacatctccctgctgatccgggatagcaagctgagcgatagcgccacctacctgtgcgtggtcacatttgctctgaccggcggcttcaagaccatcttcggagccggcaccagactgttcgtgaaggcc

SEQ ID NO: 1150 - DNA, 402 bp, Homo sapiens
  TCR 41 Codon-optimized/ cysteine-modified beta
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcaatccccgggacagagtgtcctacgagcagtactttggccctggcaccagactgaccgtgaca

SEQ ID NO: 1151 - DNA, 492 bp, Homo sapiens
  TCR 42 Codon-optimized/ cysteine-modified alpha
atgcacaccagcaccttccagaacagaccccagctgttcctgctgatctggaagaaactggtgcccggcaatcccttcaggcggtcttggatgaagcgcgagagagagatgctgctgatcacctccatgctggtgctgtggatgcagctgagccaagtgaacggccagcaagtgatgcagatccctcagtaccagcacgtgcaagaaggcgaggacttcaccacctactgcaacagcagcaccacactgagcaacatccagtggtacaagcagcggcctggcggacaccctgtgtttctgatccagctggtcaagtccggcgaagtgaagaagcagaagcggctgaccttccagttcggcgaggccaagaagaacagcagcctgcacatcaccgccacacagaccaccgatgtgggcacctacttttgcgccggacctgacaacttcaacaagttctacttcggcagcggcaccaagctgaacgtgaagccc

SEQ ID NO: 1152 - DNA, 396 bp, Homo sapiens
  TCR 42 Codon-optimized/ cysteine-modified beta
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccaagaccagcagaagcagctacgagcagtacttcggccctggcaccagactgacagtgaca

SEQ ID NO: 1153 - DNA, 405 bp, Homo sapiens
  TCR 43 Codon-optimized/ cysteine-modified alpha
atgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgttcatctacagcaacggcgacaaagaggacggccggtttacagcccagctgaacaaggccagccagtacgtgtccctgctgatcagagatagccagcctagcgacagcgccacctatctgtgtgccgtgaatgtgcctaccagcggcacctacaagtacatcttcggcaccggcaccagactgaaggtgctggct

SEQ ID NO: 1154 - DNA, 396 bp, Homo sapiens
  TCR 43 Codon-optimized/ cysteine-modified beta
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcacacccagagacagctacgagcagtatttcggccctggcaccagactgaccgtgaca

SEQ ID NO: 1155 - DNA, 432 bp, Homo sapiens
  TCR 44 Codon-optimized/ cysteine-modified alpha
atggctcaagagctgggcatgcagtgtcaggccagaggaatcctgcagcagatgtggggagtgttcctgctgtacgtgtccatgaagatgggcggcaccaccggccagaacatcgatcagcctacagagatgaccgccaccgagggcgccatcgtgcagatcaattgcacctaccagaccagcggcttcaacggcctgttctggtatcagcagcatgccggcgaggcccctaccttcctgagctacaatgtgctggacggcctggaagagaagggcagattcagcagcttcctgtccagaagcaagggctacagctacctgctgctgaaagaactgcagatgaaggacagcgcctcctacctgtgtgcccagtactctggcggctaccagaaagtgacctttggcaccggcaccaagctgcaagtgatcccc

SEQ ID NO: 1156 - DNA, 387 bp, Homo sapiens
  TCR 44 Codon-optimized/ cysteine-modified beta
atgggctttagactgctgtgctgcgtggccttctgtctgcttggagctggccctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccagtactacaacggcgaggaaagagccaagggcaacatcctggaacggttcagcgcccagcagttcccagatctgcacagcgagctgaacctgagcagcctggaactgggagatagcgccctgtacttctgtgccagcagcggcacacccgacacacagtattttggccctggcaccagactgaccgtg

SEQ ID NO: 1157 - DNA, 498 bp, Homo sapiens
  TCR 45 Codon-optimized/ cysteine-modified alpha
atgcacaccagcaccttccagaacagaccccagctgttcctgctgatctggaagaaactggtgcccggcaatcccttcaggcggtcttggatgaagcgcgagagagagatgctgctgatcacctccatgctggtgctgtggatgcagctgagccaagtgaacggccagcaagtgatgcagatccctcagtaccagcacgtgcaagaaggcgaggacttcaccacctactgcaacagcagcaccacactgagcaacatccagtggtacaagcagcggcctggcggacaccctgtgtttctgatccagctggtcaagtccggcgaagtgaagaagcagaagcggctgaccttccagttcggcgaggccaagaagaacagcagcctgcacatcaccgccacacagaccaccgatgtgggcacctatttttgcgccggatcttctggcgccggaagctaccagctgacatttggcaagggcaccaagctgagcgtgatcccc

SEQ ID NO: 1158 - DNA, 402 bp, Homo sapiens
  TCR 45 Codon-optimized/ cysteine-modified beta
atgggaaccagactgctgttctgggtcgccttctgtctgctgggcgcctatcatacaggtgccggtgtctctcagagccccagcaacaaagtgaccgagaagggcaaagacgtggaactgagatgcgaccccatcagcggacacacagccctgtactggtacagacagagactcggccagggcctcgagttcctgatctacttccaaggcaacagcgcccctgacaagagcggcctgcctagcgatagattcagcgccgagagaacaggcgagagcgtgtccacactgaccatccagagaacccagcaagaggacagcgccgtgtacctgtgtgccagctctctgtacctgggaaccaccggcgagctgttctttggcgagggctctagactgaccgtgctg

SEQ ID NO: 1159 - DNA, 399 bp, Homo sapiens
  TCR 46 Codon-optimized/ cysteine-modified alpha
atgctgctgcttctggtgcccgccttccaagtgatctttaccctcggcggaacacgggcccagtctgtgacacagctggattctcaggtgcccgtgtttgaggaagcccctgtcgagctgagatgcaactacagcagcagcgtgtccgtgtacctgttttggtacgtgcagtaccccaaccagggcctgcagctgctgctcaagtatctgagcggcagcacactggtcaagggcatcaatggcttcgaggccgagttcaacaagagccagaccagcttccatctgcggaagcccagcgtgcacatcagcgataccgccgagtacttctgcgccgtgtctcctagcagcggcacctacaagtacatcttcggcaccggcaccagactgaaggtgctggct

SEQ ID NO: 1160 - DNA, 402 bp, Homo sapiens
  TCR 46 Codon-optimized/ cysteine-modified beta
atgggaacaagactgctgtgttgggccgctctgtgtctgctgggagctgatcatacaggcgccggtgtcagccagacacctagcaacaaagtgaccgagaagggcaaatacgtggaactgagatgcgaccccatcagcggacacacagccctgtactggtacagacagtctctcggccagggacctgagttcctgatctacttccaaggcaccggcgctgccgatgatagcggcctgcctaacgatagattcttcgccgtcagacccgagggcagcgtgtccacactgaagatccagagaaccgagaggggcgacagcgccgtgtatctgtgtgccagctctctgtatctcggcggcagcgagacacagtactttggccctggtacacggctgctggttctg

SEQ ID NO: 1161 - DNA, 405 bp, Homo sapiens
  TCR 47 Codon-optimized/ cysteine-modified alpha
atgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgttcatctacagcaacggcgacaaagaggacggccggtttacagcccagctgaacaaggccagccagtacgtgtccctgctgatcagagatagccagcctagcgacagcgccacctatctgtgtgccgtgaatctgctgagcggcagcgctagacagctgacatttggctctggcacccagctgaccgtgctgcct

SEQ ID NO: 1162 - DNA, 396 bp, Homo sapiens
  TCR 47 Codon-optimized/ cysteine-modified beta
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatgaccggcagaaccacctacgagcagtatttcggccctggcaccagactgaccgtgaca

SEQ ID NO: 1163 - DNA, 399 bp, Homo sapiens
  TCR 48 Codon-optimized/ cysteine-modified alpha
atgatgaagtccctgcgggtgctgctggtcatcctgtggctgcaactgagctgggtctggtcccagcagaaagaggtggaacaggaccctggacctctgtctgttcctgagggcgccatcgtgtccctgaactgcacctacagcaacagcgccttccagtacttcatgtggtacagacagtacagccggaagggccccgagctgctgatgtacacatacagcagcggcaacaaagaggacggccggtttacagcccaggtggacaagagcagcaagtacatctccctgttcatccgggacagccagcctagcgatagcgccacatatctgtgcgccatgagaatccagggcgcccagaaactggtgttcggccagggaaccagactgaccatcaatccc

SEQ ID NO: 1164 - DNA, 396 bp, Homo sapiens
  TCR 48 Codon-optimized/ cysteine-modified beta
atggatacttggcttgtgtgctgggccatcttcagcctgctgaaggccggactgacagagcccgaagtgacacagacacccagccaccaagtgacccagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcaccggcagagtgtcctacgagcagtatttcggccctggcaccagactgaccgtgaca

SEQ ID NO: 1165 - DNA, 405 bp, Homo sapiens
  TCR 49 Codon-optimized/ cysteine-modified alpha
atgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgttcatctacagcaacggcgacaaagaggacggccggtttacagcccagctgaacaaggccagccagtacgtgtccctgctgatcagagatagccagcctagcgacagcgccacctatctgtgcgccgtgaatatcggcaccagcggcacctacaagtacatcttcggcaccggcaccagactgaaggtgctggct

SEQ ID NO: 1166 - DNA, 396 bp, Homo sapiens
  TCR 49 Codon-optimized/ cysteine-modified beta
atggatacctggctcgtgtgctgggccatcttcagcctgctgaaagccggactgaccgagcctgaagtgacccagacacctagccaccaagtgacacagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcacaccccggtacagctacgagcagtatttcggccctggcaccagactgaccgtgaca

SEQ ID NO: 1167 - DNA, 396 bp, Homo sapiens
  TCR 50 Codon-optimized/ cysteine-modified alpha
atgaagaccttcgccggcttcagcttcctgttcctgtggctgcagctggactgcatgagcagaggcgaggatgtggaacagagcctgtttctgagcgtccgcgagggcgatagcagcgtgatcaattgcacctacaccgacagcagcagcacctacctgtactggtacaagcaagagcctggcgccggactgcagctgctgacctacatcttcagcaacatggacatgaagcaggaccagcggctgaccgtgctgctgaacaagaaggacaagcacctgagcctgcggatcgccgatacacagacaggcgacagcgccatctacttttgcgccgagtctcctccaggcacctacaagtacatcttcggcaccggcaccagactgaaggtgctggct

SEQ ID NO: 1168 - DNA, 396 bp, Homo sapiens
  TCR 50 Codon-optimized/ cysteine-modified beta
atgggcttcagactgctgtgctgcgtggccttttgtctgcttggagccggacctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccactactacaacggcgaggaaagagccaagggcaacatcctggaacggttcagcgcccagcagttcccagatctgcacagcgagctgaacctgagcagcctggaactgggagatagcgccctgtacttctgtgccagcagcgccacaagagatgcctacggctacacatttggcagcggcaccagactgacagtggtg

SEQ ID NO: 1169 - DNA, 408 bp, Homo sapiens
  TCR 51 Codon-optimized/ cysteine-modified alpha
atgatgaagtccctgcgggtgctgctggtcatcctgtggctgcaactgagctgggtctggtcccagcagaaagaggtggaacagaacagcggccctctgtctgttcctgaaggcgctatcgccagcctgaactgcacctacagcgatagaggcagccagagcttcttctggtacagacagtacagcggcaagagccccgagctgatcatgagcatctacagcaacggcgacaaagaggacggccggtttacagcccagctgaacaaggccagccagtacgtgtccctgctgatcagagatagccagcctagcgacagcgccacctatctgtgcgccgtgaatatgagaggcggcggaagcaactacaagctgacctttggcaagggcaccctgctgaccgtgaatccc

SEQ ID NO: 1170 - DNA, 396 bp, Homo sapiens
  TCR 51 Codon-optimized/ cysteine-modified beta
atggatacctggctcgtgtgctgggccatcttcagcctgctgaaagccggactgaccgagcctgaagtgacccagacacctagccaccaagtgacacagatgggccaagaagtgatcctgcgctgcgtgcccatcagcaaccacctgtacttctactggtacagacagatcctgggccagaaagtggaattcctggtgtccttctacaacaacgagatcagcgagaagtccgagatcttcgacgaccagttcagcgtggaaagacccgacggcagcaacttcaccctgaagatcagaagcaccaagctcgaggacagcgccatgtacttttgcgccattgccagccgggtgtcctacgagcagtatttcggccctggcaccagactgaccgtgaca

SEQ ID NO: 1171 - DNA, 381 bp, Homo sapiens
  TCR 52 Codon-optimized/ cysteine-modified alpha
atggtgctgaagttcagcgtgtccatcctgtggatccagctggcctgggtttccacacagctgctggaacagagccctcagttcctgagcatccaagagggcgagaacctgaccgtgtactgcaacagcagcagcgtgttcagcagcctgcagtggtacagacaagagcctggcgaaggacctgtgctgctggtcacagttgtgacaggcggcgaagtgaagaagctgaagcggctgaccttccagttcggcgacgccagaaaggatagctccctgcacattaccgctgctcagccaggcgataccggcctgtatctttgtgccggcgctcgggattacaagctgtcttttggcgccggaaccaccgtgacagtgcgggct

SEQ ID NO: 1172 - DNA, 396 bp, Homo sapiens
  TCR 52 Codon-optimized/ cysteine-modified beta
atgggcttcagactgctgtgctgcgtggccttttgtctgcttggagccggacctgtggatagcggcgttacccagacacctaagcacctgatcacagccacaggccagcgcgtgaccctgagatgttctcctagaagcggcgacctgagcgtgtactggtatcagcagtctctggaccagggcctgcagttcctgatccagtactacaacggcgaggaaagagccaagggcaacatcctggaacggttcagcgcccagcagttcccagatctgcacagcgagctgaacctgagcagcctggaactgggagatagcgccctgtacttctgtgccagctctgtgggcgatctgaacaacgagcagttcttcggccctggcaccagactgacagttctg

SEQ ID NO: 1173 - DNA, 402 bp, Homo sapiens
  TCR 53 Codon-optimized/ cysteine-modified alpha
atggccagcgctcctatctctatgctggccatgctgttcaccctgagcggactgagagcacagtctgtggcccagcctgaggaccaagtgaatgtggccgagggcaatcccctgaccgtgaagtgtacctacagcgtgtccggcaatccctacctgttttggtacgtgcagtaccccaaccggggcctgcagttcctgctgaagtacatcaccggcgacaacctggtcaagggcagctatggattcgaggccgagttcaacaagagccagaccagcttccacctgaagaaacccagcgctctggtgtccgatagcgccctgtatttctgcgccgtcagagattttggcagcggcacctacaagtacatcttcggcaccggcaccagactgaaggtgctggct

SEQ ID NO: 1174 - DNA, 404 bp, Homo sapiens
  TCR 53 Codon-optimized/ cysteine-modified beta
atgggcacaagcctgctgtgttgggtcgtgctgggctttctgggcacagatcatacaggcgccggtgtcagccagtctcctcggtacaaagtgaccaagcgcggacaggatgtggccctgagatgcgatcctatctctggccacgtgtccctgtactggtacagacaggctctcggacagggccccgagttcctgacctacttcaattacgaggcccagcaggacaagagcggcctgcctaacgatagattcagcgccgaaagacccgagggcagcatcagcacactgaccatccagagaaccgagcagagggacagcgccatgtacagatgtgcctctagcggcagcggcaccagcggctacaatgagcagtttttcggccctggcaccagactgacagtgct

SEQ ID NO: 1175 - DNA, 402 bp, Homo sapiens
  TCR 54 Codon-optimized/ cysteine-modified alpha
atgaagaagcacctgaccacctttctggtcatcctgtggctgtacttctacagaggcaacggcaagaaccaggtggaacagagccctcagagcctgatcatcctggaaggcaagaactgcaccctgcagtgcaactacaccgtgtctcccttcagcaacctgcggtggtacaagcaggatacaggcagaggccctgtgtctctgaccatcatgaccttcagcgagaacaccaagagcaacggcagatacaccgccacactggacgccgatacaaagcagagcagcctgcacatcacagccagccagctgagcgatagcgccagctacatctgcgtggtgtccagagacaactacggccagaacttcgtgttcggccctggcacaagactgagcgtgctgcct

SEQ ID NO: 1176 - DNA, 396 bp, Homo sapiens
  TCR 54 Codon-optimized/ cysteine-modified beta
atggatacttggctcgtgtgctgggccatcttcagcctgctgaaagccggactgaccgagcctgaagtgacacagacacctagccaccaagtgacccagatgggccaagaggtcatactgagatgcgtgcccatcagcaaccacctgtacttctactggtacagacagatcctgggccagaaggtggaattcctcgtcagcttctacaacaacgagatcagcgagaagtccgagatcttcgacgaccagttcagcgtggaaagacccgacggcagcaacttcaccctgaagatcagaagcaccaagctcgaggacagcgccatgtacttttgcgccatcaccgaccggaccaactacggctacacatttggcagcggcaccagactgacagtggtc

SEQ ID NO: 1177 - DNA, 396 bp, Homo sapiens
  TCR 55 Codon-optimized/ cysteine-modified alpha
atgaagaccttcgccggcttcagcttcctgttcctgtggctgcagctggactgtatgagcagaggcgaggatgtggaacagagcctgtttctgagcgtcagagaaggcgacagcagcgtgatcaactgcacctacaccgacagctccagcacctacctgtactggtacaagcaagaacctggcgccggactgcagctgctgacctacatcttcagcaacatggacatgaagcaggaccagcggctgaccgtgctgctgaacaagaaggataagcacctgagcctgcggatcgccgatacacagacaggcgactccgccatctacttttgtgctgtgcctagcggcgccaccaacaagctgatctttggaacaggcacactgctggccgtgcagccc

SEQ ID NO: 1178 - DNA, 396 bp, Homo sapiens
  TCR 55 Codon-optimized/ cysteine-modified beta
atggatacttggctcgtgtgctgggccatcttcagcctgctgaaagccggactgaccgagcctgaagtgacacagacacctagccaccaagtgacccagatgggccaagaggtcatactgagatgcgtgcccatcagcaaccacctgtacttctactggtacagacagatcctgggccagaaggtggaattcctcgtcagcttctacaacaacgagatcagcgagaagtccgagatcttcgacgaccagttcagcgtggaaagacccgacggcagcaacttcaccctgaagatcagaagcaccaagctcgaggacagcgccatgtacttttgcgccagcaccaccagaagcagctacgagcagtatttcggccctggcaccagactgaccgtgaca

SEQ ID NO: 1179 - DNA, 66 bp, Artificial Sequence
  TCR 15/ TCR 16/ TCR 17/ TCR 18/ TCR 19/  TCR 20/ TCR 21/ TCR22/ TCR 23/ TCR 24/ TCR 25/ TCR 26/ TCR 27/ TCR 28/ TCR 29/ TCR 30/ TCR 31/ TCR 32/ TCR 33/ TCR 34 P2A
ggctctggcgccaccaactttagcctgctgaagcaggccggcgatgtggaggagaatcctggccca

SEQ ID NO: 1180 - DNA, 66 bp, Artificial Sequence
  TCR 35/ TCR 36/ TCR 38/ TCR 40/ TCR 41/ TCR 42/ TCR 43/ TCR 44/ TCR 45/ TCR 46/ TCR 47/ TCR 48 P2A
ggaagcggcgccacaaacttctcactgctgaaacaggctggcgacgtggaggagaatcctggccca

SEQ ID NO: 1181 - DNA, 66 bp, Artificial Sequence
  TCR 37/ TCR 39 P2A
ggcagcggcgccaccaacttcagcctgcttaaacaagctggcgacgtggaggagaatcctggccca

SEQ ID NO: 1182 - DNA, 20 bp, Homo sapiens
  TRAC target sequence
attcaccgattttgattctc

SEQ ID NO: 1183 - protein, 14 aa, Artificial Sequence
  TCR alpha E7(11-19) CDR3 consensus
  VARIANT (1)...(1): X1 is V or A
  VARIANT (2)...(2): X2 is V, A, G, Q, M, or E
  VARIANT (3)...(3): X3 is  S, G, A, N,Y, R,T, or P
  VARIANT (4)...(4): X4 is E, A, S, G, R. F, N, D, V, P, L, I, or M
  VARIANT (5)...(5): X5 is R, N, H, T, D, G, S, A, P, L, Q, or F
  VARIANT (6)...(6): X6 is G, H, N, A, S, L, T, or null
  VARIANT (7)...(7): X7 is T, S, G, or null
  VARIANT (8)...(8): X8 is G or null
  VARIANT (9)...(9): X9 is G, Y, N, S, or null
  VARIANT (10)...(10): X10 is T, G, S, D, F, Y, A, N, or null
  VARIANT (11)...(11): X11 is Y, F, Y, Q, N, or R
  VARIANT (12)...(12): X12 is N, K, Q, or D
  VARIANT (13)...(13): X13 is Y, L, T, F, M, or V
  VARIANT (14)...(14): X14 is I, T, S, V, R, or Y
XXXXXXXXXXXXXX

SEQ ID NO: 1184 - protein, 13 aa, Artificial Sequence
  TCR alpha E7(11-19) CDR3 consensus
  VARIANT (3)...(3): X3 is S, N, or T
  VARIANT (4)...(4): X4 is R or F
  VARIANT (5)...(5): X5 is D or A
  VARIANT (6)...(6): X6 is N or L
  VARIANT (7)...(7): X7is T or null
  VARIANT (8)...(8): X8 is Y or G
  VARIANT (10)...(10): X10 is Q or F
  VARIANT (11)...(11): X11 is N or K
  VARIANT (12)...(12): X12 is F or T
  VARIANT (13)...(13): X13 is V or I
VVXXXXXXGXXXX

SEQ ID NO: 1185 - protein, 14 aa, Artificial Sequence
  TCR alpha E7(11-19) CDR3 consensus
  VARIANT (2)...(2): X2 is A, G, V, Q, M, or E
  VARIANT (3)...(3): X3 is  S, G, N, A, Y, R, or P
  VARIANT (4)...(4): X4 is E, S, A, G, F, N, D, V, P, L, I, M, or R
  VARIANT (5)...(5): X5 is R, N, H, T, D, G, S, P, L, Q, or F
  VARIANT (6)...(6): X6 is G, H, A, S, T, or null
  VARIANT (7)...(7): X7 is T, S, G, or null
  VARIANT (8)...(8): X8 is G or null
  VARIANT (9)...(9): X9 is G, N, S, or null
  VARIANT (10)...(10): X10 is T, G, S, D, F, Y, A, or N
  VARIANT (11)...(11): X11 is Y, F, Q, R, or N
  VARIANT (12)...(12): X12 is K, Q, or D
  VARIANT (13)...(13): X13 is Y, L, T, M, F, or V
  VARIANT (14)...(14): X14is I, T, S, R, Y, or V
AXXXXXXXXXXXXX

SEQ ID NO: 1186 - protein, 13 aa, Artificial Sequence
  TCR alpha E7(11-19) CDR3 consensus
  VARIANT (1)...(1): X1 is A or V
  VARIANT (2)...(2): X2 is A, V, or E
  VARIANT (3)...(3): X3 is  S, N, T, R, or P
  VARIANT (4)...(4): X4 is E, A, G, F, V, P, I, D, or S
  VARIANT (5)...(5): X5 is R, H, T, A P, S, G, or F
  VARIANT (6)...(6): X6 is G, H, L, T, S, A, or null
  VARIANT (7)...(7): X7 is S, T, or null
  VARIANT (8)...(8): X8 is G or null
  VARIANT (9)...(9): X9 is G, T, or null
  VARIANT (10)...(10): X10 is F, Y, or N
  VARIANT (12)...(12): X12 is Y, T, L
XXXXXXXXXXKXI

SEQ ID NO: 1187 - protein, 13 aa, Artificial Sequence
  TCR alpha E7(11-19) CDR3 consensus
  VARIANT (2)...(2): X2 is A, V, or E
  VARIANT (3)...(3): X3 is  S, N, or R
  VARIANT (4)...(4): X4 is E, G, V, P, I, or D
  VARIANT (5)...(5): X5 is R, T, P, S, G, or F
  VARIANT (6)...(6): X6 is G, T, S, or null
  VARIANT (7)...(7): X7is S or null
  VARIANT (8)...(8): X8 is G or null
  VARIANT (9)...(9): X9 is T or null
AXXXXXXXXYKYI

SEQ ID NO: 1188 - protein, 14 aa, Artificial Sequence
  TCR alpha E7(11-19) CDR3 consensus
  VARIANT (2)...(2): X2 is G, V, Q, or M
  VARIANT (3)...(3): X3 is  G, A, Y, S, N, or R
  VARIANT (4)...(4): X4 is S, G, L, I, M, or R
  VARIANT (5)...(5): X5 is N, D, G, S, L, Q, or R
  VARIANT (6)...(6): X6 is A, S, G, or null
  VARIANT (7)...(7): X7 is G or null
  VARIANT (8)...(8): X8 is G or null
  VARIANT (9)...(9): X9 is G, N, S, or null
  VARIANT (10)...(10): X10 is S, D, Y, A, N, or null
  VARIANT (11)...(11): X11 is Y, Q, or R
  VARIANT (12)...(12): X12 is K or Q
  VARIANT (13)...(13): X13 is L or V
  VARIANT (14)...(14): X14 is S, T, or V
AXXXXXXXXXXXXX

SEQ ID NO: 1189 - protein, 14 aa, Artificial Sequence
  TCR alpha E7(11-19) CDR3 consensus
  VARIANT (2)...(2): X2 is G, V, or Q
  VARIANT (3)...(3): X3 is  G, Y, S, or N
  VARIANT (4)...(4): X4 is S,  L,  or M
  VARIANT (5)...(5): X5 is N, G, L, or R
  VARIANT (6)...(6): X6 is A, S, G, or null
  VARIANT (7)...(7): X7 is G or null
  VARIANT (8)...(8): X8 is G or null
  VARIANT (9)...(9): X9 is G, S or null
  VARIANT (10)...(10): X10 is S, Y, A, N, or null
  VARIANT (11)...(11): X11 is Y, Q, or R
  VARIANT (12)...(12): X12 is K or Q
  VARIANT (13)...(13): X13 is L or V
AXXXXXXXXXXXXT

SEQ ID NO: 1190 - protein, 11 aa, Artificial Sequence
  TCR alpha E7(11-19) CDR3 consensus
  VARIANT (2)...(2): X2 is G or V
  VARIANT (3)...(3): X3 is  A or Y
  VARIANT (4)...(4): X4 is G, S, or R
  VARIANT (5)...(5): X5 is D, or S
  VARIANT (6)...(6): X6 is N, or null
  VARIANT (7)...(7): X7 is D or null
AXXXXXXYKLS

SEQ ID NO: 1191 - protein, 6 aa, Artificial Sequence
  TCR alpha E7(11-19) CDR1 consensus
  VARIANT (1)...(1): X1 is N, S, D, T, or V
  VARIANT (2)...(2): X2 is S, V, R, T, or I
  VARIANT (3)...(3): X3 is  M, F, G, S, N, A, L, V, or P
  VARIANT (4)...(4): X4 is F, S, N, A, or null
  VARIANT (5)...(5): X5 is D, S, Q, Y, N, V, T, or P
  VARIANT (6)...(6): X6 is Y, S, R, N, G, or T
XXXXXX

SEQ ID NO: 1192 - protein, 8 aa, Artificial Sequence
  TCR alpha E7(11-19) CDR2 consensus
  VARIANT (1)...(1): X1 is I, V, L, G, , N, T, Y, or M
  VARIANT (2)...(2): X2 is S, V, Y, L, P, F, I, or T
  VARIANT (3)...(3): X3 is  S, Y, K, L, T, or F
  VARIANT (4)...(4): X4 is I, G, N, A, S, or null
  VARIANT (5)...(5): X5 is S, D, or null
  VARIANT (6)...(6): X6 is K, G, N, S, D, T, or E
  VARIANT (7)...(7): X7 is D, E, G, A, K, L, or N
  VARIANT (8)...(8): X8 is K, V, D, P, N, T, L, or M
XXXXXXXX

SEQ ID NO: 1193 - protein, 14 aa, Artificial Sequence
  TCR beta E7(11-19) CDR3 consensus
  VARIANT (2)...(2): X2 is S, M, I, K, or V
  VARIANT (3)...(3): X3 is  S, T, N, or A
  VARIANT (4)...(4): X4 is R, V P, S, T, G, L, A, I, or D
  VARIANT (5)...(5): X5 is F, G, R, Y, S, L, V, or T
  VARIANT (6)...(6): X6 is L, G, D, A, S, T, V, R, or null
  VARIANT (7)...(7): X7is G, D, R, S, T, or null
  VARIANT (8)...(8): X8 is S or null
  VARIANT (9)...(9): X9 is S, H, G, R, V, T, D, L, or null
  VARIANT (10)...(10): X10 is T, S, A, Y, N, G, or P
  VARIANT (11)...(11): X11 is D,Y, N, E, K, or G
  VARIANT (12)...(12): X12 is T, E, G, or K
  VARIANT (13)...(13): X13 is Q, Y, A, or L
  VARIANT (14)...(14): X14is Y, F, T, or I
AXXXXXXXXXXXXX

SEQ ID NO: 1194 - protein, 12 aa, Artificial Sequence
  TCR beta E7(11-19) CDR3 consensus
  VARIANT (2)...(2): X2 is S, M, I, or K
  VARIANT (4)...(4): X4 is P, T, G, A, S, or D
  VARIANT (5)...(5): X5 is R or S
  VARIANT (6)...(6): X6 is D, G, S, T, or V
  VARIANT (7)...(7): X7 is R, S, or null
  VARIANT (8)...(8): X8 is T, Y, G, N, or S
  VARIANT (9)...(9): X9 isY, N, or K
  VARIANT (10)...(10): X10 is E or G
  VARIANT (11)...(11): X11 is Q, A, or Y
  VARIANT (12)...(12): X12 is Y, F, or T
AXTXXXXXXXXX

SEQ ID NO: 1195 - protein, 14 aa, Artificial Sequence
  TCR beta E7(11-19) CDR3 consensus
  VARIANT (2)...(2): X2 is S, M, I, or K
  VARIANT (3)...(3): X3 is  S, T, A, or N
  VARIANT (4)...(4): X4 is R, V, S, P, T, G, L, or A
  VARIANT (5)...(5): X5 is F, G, R, Y, S, V, or T
  VARIANT (6)...(6): X6 is L, G, D, A, S, T, V, or null
  VARIANT (7)...(7): X7 is G, D, R, T, or null
  VARIANT (8)...(8): X8 is S or null
  VARIANT (9)...(9): X9 is S, H, G, R, V, T, L, or null
  VARIANT (10)...(10): X10 is T, S, Y, A, N, G, or P
  VARIANT (11)...(11): X11 is D, Y, N, K, E, or G
  VARIANT (12)...(12): X12 is T or E
  VARIANT (13)...(13): X13 is Q, A, or L
  VARIANT (14)...(14): X14 is Y or F
AXXXXXXXXXXXXX

SEQ ID NO: 1196 - protein, 13 aa, Artificial Sequence
  TCR beta E7(11-19) CDR3 consensus
  VARIANT (2)...(2): X2 is S, M, I, or K
  VARIANT (3)...(3): X3 is  S, T, A, or N
  VARIANT (4)...(4): X4 is R, P, S, G, L, A, or T
  VARIANT (5)...(5): X5 is F, R, Y, V, or T
  VARIANT (6)...(6): X6 is L, D, A, S, T, V, or null
  VARIANT (7)...(7): X7 is G, R, or null
  VARIANT (8)...(8): X8 is S, G, V, or null
  VARIANT (9)...(9): X9 is T, A, G, N, S, or P
  VARIANT (10)...(10): X10 is D, Y, or E
  VARIANT (11)...(11): X11 is T or E
AXXXXXXXXXXQY

SEQ ID NO: 1197 - protein, 13 aa, Artificial Sequence
  TCR beta E7(11-19) CDR3 consensus
  VARIANT (2)...(2): X2 is S, M, I, or K
  VARIANT (3)...(3): X3 is  S, T, A, or N
  VARIANT (4)...(4): X4 is P, S, G, T,  or A
  VARIANT (5)...(5): X5 is  R or Y
  VARIANT (6)...(6): X6 is D, A, S, T, or V
  VARIANT (7)...(7): X7 is R or null
  VARIANT (8)...(8): X8 is G, V, or null
  VARIANT (9)...(9): X9 is S, T, A, or N
AXXXXXXXXYEQY

SEQ ID NO: 1198 - protein, 14 aa, Artificial Sequence
  TCR beta E7(11-19) CDR3 consensus
  VARIANT (4)...(4): X4 is T, P, or G
  VARIANT (5)...(5): X5 is R or S
  VARIANT (6)...(6): X6 is S, D, G, or V
  VARIANT (7)...(7): X7 is D or null
  VARIANT (8)...(8): X8 is S or null
  VARIANT (9)...(9): X9 is S, R, or null
  VARIANT (10)...(10): X10 is S, T, Y, or G
  VARIANT (11)...(11): X11 is Y, N, or K
  VARIANT (13)...(13): X13 is Q or A
  VARIANT (14)...(14): X14 is Y or F
ASTXXXXXXXXEXX

SEQ ID NO: 1199 - protein, 12 aa, Artificial Sequence
  TCR beta E7(11-19) CDR3 consensus
  VARIANT (2)...(2): X2 is S or I
  VARIANT (3)...(3): X3 is  S or T
  VARIANT (4)...(4): X4 is L, A, or D
  VARIANT (5)...(5): X5 is L, T, or R
  VARIANT (6)...(6): X6 is L, T, or R
  VARIANT (7)...(7): X7 is G, D, or null
  VARIANT (8)...(8): X8 is A or N
AXXXXXXXYGYT

SEQ ID NO: 1200 - protein, 14 aa, Artificial Sequence
  TCR beta E7(11-19) CDR3 consensus
  VARIANT (2)...(2): X2 is S, V, or I
  VARIANT (3)...(3): X3 is  S, N, or A
  VARIANT (4)...(4): X4 is R, V, S, L, P, G, I, or A
  VARIANT (5)...(5): X5 is F, G, Y, L, V, R, T, or S
  VARIANT (6)...(6): X6 is L, G, A, D, R, V, or null
  VARIANT (7)...(7): X7 is G, D, R, S, T, or null
  VARIANT (8)...(8): X8 is S or null
  VARIANT (9)...(9): X9 is S, H, G, V, T, D, L, or null
  VARIANT (10)...(10): X10 is T, S, A, G, P, N, or Y
  VARIANT (11)...(11): X11 is D, Y, E, G, or N
  VARIANT (12)...(12): X12 is T, E, G, or K
  VARIANT (13)...(13): X13 is Q, Y, or L
  VARIANT (14)...(14): X14 is Y, F, T, or I
AXXXXXXXXXXXXX

SEQ ID NO: 1201 - protein, 14 aa, Artificial Sequence
  TCR beta E7(11-19) CDR3 consensus
  VARIANT (4)...(4): X4 is R, V, S, L, G, or A
  VARIANT (5)...(5): X5 is F, G, Y, L, V, T, or S
  VARIANT (6)...(6): X6 is A, L, R, D, G, or null
  VARIANT (7)...(7): X7 is G, D, T, or null
  VARIANT (8)...(8): X8 is S or null
  VARIANT (9)...(9): X9 is S, H, G, T, D, L, or null
  VARIANT (10)...(10): X10 is T, S, A, G, P, N, or Y
  VARIANT (11)...(11): X11 is D, Y, E, G, or N
  VARIANT (12)...(12): X12 isT, E, G, or T
  VARIANT (13)...(13): X13 is Q, Y, or L
  VARIANT (14)...(14): X14 isY, F, or T
ASSXXXXXXXXXXX

SEQ ID NO: 1202 - protein, 13 aa, Artificial Sequence
  TCR beta E7(11-19) CDR3 consensus
  VARIANT (4)...(4): X4 is R, L, or G
  VARIANT (5)...(5): X5 is F, V, T, or Y
  VARIANT (6)...(6): X6 is L, A, or null
  VARIANT (7)...(7): X7 is G, or null
  VARIANT (8)...(8): X8 is S, G, or null
  VARIANT (9)...(9): X9 is T, G, P, or S
  VARIANT (10)...(10): X10 is D or E
ASSXXXXXXXTQY

SEQ ID NO: 1203 - protein, 5 aa, Artificial Sequence
  TCR beta E7(11-19) CDR1 consensus
  VARIANT (2)...(2): X2 is G or N
  VARIANT (3)...(3): X3 is  H or D
  VARIANT (4)...(4): X4 isT, L, N, or V
  VARIANT (5)...(5): X5 is A, S, Y, or T
SXXXX

SEQ ID NO: 1204 - protein, 6 aa, Artificial Sequence
  TCR beta E7(11-19) CDR1 consensus
  VARIANT (1)...(1): X1 is F or Y
  VARIANT (2)...(2): X2 is Q, Y, or N
  VARIANT (3)...(3): X3 is  G, N, R, or Y
  VARIANT (4)...(4): X4 is N, G, E, or T
  VARIANT (5)...(5): X5 is S, E, A, or G
  VARIANT (6)...(6): X6 is A, E, I, or Q
XXXXXX

SEQ ID NO: 1205 - protein, 18 aa, Artificial Sequence
  TCR alpha E6(29-38) CDR3 consensus
  VARIANT (1)...(1): X1 is A, I, or V
  VARIANT (2)...(2): X2 is M, L, A, V, S, or E
  VARIANT (3)...(3): X3 is  R, L, N, S, Q, K, G, or W
  VARIANT (4)...(4): X4 is E, V, P, T, F, A, G, N, D, or L
  VARIANT (5)...(5): X5 is G, I, D, L, A, P, H, N, R, T, or null
  VARIANT (6)...(6): X6 is G, N, R, T, M, S, P, or null
  VARIANT (7)...(7): X7 is G, V, D, L, Q, T, R, N, or null
  VARIANT (8)...(8): X8 is T, D, S, L, G, or null
  VARIANT (9)...(9): X9 is A, G, Q, or null
  VARIANT (10)...(10): X10 is G, or null
  VARIANT (11)...(11): X11 is G or null
  VARIANT (12)...(12): X12 is T or null
  VARIANT (13)...(13): X13 is S, A, T, G, or null
  VARIANT (14)...(14): X14 is G, Y, T, N, A, W, or null
  VARIANT (15)...(15): X15 is F, G, N, T, Y, D, S, R, Q, or E
  VARIANT (16)...(16): X16 is K, P, A, N, D, or Q
  VARIANT (17)...(17): X17 is L, M, I, V, or T
  VARIANT (18)...(18): X18 is I, T, V, N, F, R, or Q
XXXXXXXXXXXXXXXXXX

SEQ ID NO: 1206 - protein, 18 aa, Artificial Sequence
  TCR alpha E6(29-38) CDR3 consensus
  VARIANT (1)...(1): X1 is A, I, or V
  VARIANT (2)...(2): X2 is L, M, V, or E
  VARIANT (3)...(3): X3 is  L, R, N, G, or S
  VARIANT (4)...(4): X4 is V, T, F, N, E, P, G, or L
  VARIANT (5)...(5): X5 is I, A, P, N, G, or T
  VARIANT (6)...(6): X6 is R, G, S, or T
  VARIANT (7)...(7): X7 is G, R, L, V, or T
  VARIANT (8)...(8): X8 is T, G, L, or null
  VARIANT (9)...(9): X9 is A, G, Q, or null
  VARIANT (10)...(10): X10 is G, or null
  VARIANT (11)...(11): X11 is G, or null
  VARIANT (12)...(12): X12 is T or null
  VARIANT (13)...(13): X13 is S, T, or G
  VARIANT (14)...(14): X14 is Y, A, G, or N
  VARIANT (15)...(15): X15 is G, S, N, R, or E
  VARIANT (16)...(16): X16 is K or Q
XXXXXXXXXXXXXXXXLT

SEQ ID NO: 1207 - protein, 15 aa, Artificial Sequence
  TCR alpha E6(29-38) CDR3 consensus
  VARIANT (4)...(4): X4 is E, T, A, D, or L
  VARIANT (5)...(5): X5 is G, A, N, or R
  VARIANT (6)...(6): X6 is R, G, R, T, M, or S
  VARIANT (7)...(7): X7 is G, V, D, L, or null
  VARIANT (8)...(8): X8 is T, D, or null
  VARIANT (9)...(9): X9 is G or null
  VARIANT (10)...(10): X10 is S, T, G, or null
  VARIANT (11)...(11): X11 is G, Y, N, A, or W
  VARIANT (12)...(12): X12 is F, G, N, D, S, or Y
  VARIANT (13)...(13): X13 is K, D,or Q
  VARIANT (14)...(14): X14 is T, L, M, or I
  VARIANT (15)...(15): X15 is I, T, R, or Q
AMRXXXXXXXXXXXX

SEQ ID NO: 1208 - protein, 18 aa, Artificial Sequence
  TCR alpha E6(29-38) CDR3 consensus
  VARIANT (1)...(1): X1 is I or V
  VARIANT (2)...(2): X2 is L or V
  VARIANT (3)...(3): X3 is  L, N, or R
  VARIANT (4)...(4): X4 is V, F, or G
  VARIANT (5)...(5): X5 is I, P, G, or T
  VARIANT (6)...(6): X6 is R, S, P, or G
  VARIANT (7)...(7): X7 is G, R, Q, T, or V
  VARIANT (8)...(8): X8 is T, G, S, or L
  VARIANT (9)...(9): X9 is A, G, Q, or null
  VARIANT (10)...(10): X10 is G or null
  VARIANT (11)...(11): X11 is G or null
  VARIANT (12)...(12): X12 is T or null
  VARIANT (13)...(13): X13 is G or S
  VARIANT (14)...(14): X14 is Y or N
  VARIANT (15)...(15): X15 is G, Q, or E
  VARIANT (17)...(17): X17 is V or L
  VARIANT (18)...(18): X18 is I or T
XXXXXXXXXXXXXXXKXX

SEQ ID NO: 1209 - protein, 7 aa, Artificial Sequence
  TCR alpha E6(29-38) CDR1consensus
  VARIANT (1)...(1): X1 is T, N, D, or S
  VARIANT (2)...(2): X2 is S, I, or R
  VARIANT (3)...(3): X3 is  D, S, M, A, Y, N, or G
  VARIANT (4)...(4): X4 is Q, G, P, or null
  VARIANT (5)...(5): X5 is S, T, F, I, or N
  VARIANT (6)...(6): X6 is Y, D, Q, P, N, or E
  VARIANT (7)...(7): X7 is G, Y, N, S, or A
XXXXXXX

SEQ ID NO: 1210 - protein, 8 aa, Artificial Sequence
  TCR alpha E6(29-38) CDR2consensus
  VARIANT (1)...(1): X1 is Q, G, I, V, Y, M, R, or N
  VARIANT (2)...(2): X2 is G, L, S, Q, Y, T, N, or V
  VARIANT (3)...(3): X3 is  S, T, L, or K
  VARIANT (4)...(4): X4 is Y, I, S, A, N, F, or null
  VARIANT (5)...(5): X5 is D, A, or null
  VARIANT (6)...(6): X6 is E, K, Q, S, T, G, D, or null
  VARIANT (7)...(7): X7 is Q, S, N, R, G, L, or D
  VARIANT (8)...(8): X8 is N, K, E, V, or L
XXXXXXXX

SEQ ID NO: 1211 - protein, 15 aa, Artificial Sequence
  TCR beta E6(29-38) CDR3 consensus
  VARIANT (1)...(1): X1 is A, S, or V
  VARIANT (2)...(2): X2 is S, A, or V
  VARIANT (3)...(3): X3 is  S, V, R, or Q
  VARIANT (4)...(4): X4 is H, P, Q, L, Y, G, T, F, S, R, or E
  VARIANT (5)...(5): X5 is L, G, R, W, F, S, V, T, Y, Q, or null
  VARIANT (6)...(6): X6 is A, G, L, T, E, P, or null
  VARIANT (7)...(7): X7 is G, T, A, R, Q, N, S, or null
  VARIANT (8)...(8): X8 is G, S, or null
  VARIANT (9)...(9): X9 is G or null
  VARIANT (10)...(10): X10 is F, G, A, S, T, R, Q, L, or null
  VARIANT (11)...(11): X11 is T, N, F, A, R, S, G, or null
  VARIANT (12)...(12): X12 is G, T, L D, Y, N, Q, S, or E
  VARIANT (13)...(13): X13 is E, W, T,G,  K, N, or P
  VARIANT (14)...(14): X14 is L, A, K, Q, Y, or I
  VARIANT (15)...(15): X15 is F, H, Y, T, or I
XXXXXXXXXXXXXXX

SEQ ID NO: 1212 - protein, 14 aa, Artificial Sequence
  TCR beta E6(29-38) CDR3 consensus
  VARIANT (4)...(4): X4 is H, P, Q, L, Y, F, R, or E
  VARIANT (5)...(5): X5 is L, G, R, W, F, S, V, T, Y, or Q
  VARIANT (6)...(6): X6 is A, G, L, E or P
  VARIANT (7)...(7): X7 is G, T, A, R, Q, S, or null
  VARIANT (8)...(8): X8 is G, S, or null
  VARIANT (9)...(9): X9 is F, G, A, S, T,R, L, or null
  VARIANT (10)...(10): X10 is T, N, A, F, R, S, or G
  VARIANT (11)...(11): X11 is G, T, L, D, Y, Q, S, E, or N
  VARIANT (12)...(12): X12 is E, W, T, G, P,  or K
  VARIANT (13)...(13): X13 is L, A, K, Q, Y, or I
  VARIANT (14)...(14): X14  is F, H, Y, or T
ASSXXXXXXXXXXX

SEQ ID NO: 1213 - protein, 15 aa, Artificial Sequence
  TCR beta E6(29-38) CDR3 consensus
  VARIANT (1)...(1): X1 is A or S
  VARIANT (2)...(2): X2 is S, V, or A
  VARIANT (3)...(3): X3 is  S or V
  VARIANT (4)...(4): X4 is L, Y, P, or S
  VARIANT (5)...(5): X5 is W, F, V, L, or Y
  VARIANT (6)...(6): X6 is G, T, or A
  VARIANT (7)...(7): X7 is A, R, Q, S, or null
  VARIANT (8)...(8): X8 is G or null
  VARIANT (9)...(9): X9 is G or null
  VARIANT (10)...(10): X10 is S, T, R, or G
  VARIANT (11)...(11): X11 is T, A, R, S, or N
  VARIANT (12)...(12): X12 is D, Y, T, or G
  VARIANT (13)...(13): X13 is T or E
XXXXXXXXXXXXXQY

SEQ ID NO: 1214 - protein, 13 aa, Artificial Sequence
  TCR beta E6(29-38) CDR3 consensus
  VARIANT (3)...(3): X3 is S, Q, or R
  VARIANT (4)...(4): X4 is H, P, T, or E
  VARIANT (5)...(5): X5 is L, G, W, or F
  VARIANT (6)...(6): X6 is A, G, or null
  VARIANT (7)...(7): X7 is G, N, S, R, or null
  VARIANT (8)...(8): X8 is F, G, Q, L, A, or null
  VARIANT (9)...(9): X9 is T, N, or A
  VARIANT (10)...(10): X10 is G, T, N, or E
  VARIANT (11)...(11): X11 is E, N, or K
  VARIANT (12)...(12): X12 is L, A, or Q
ASXXXXXXXXXXF

SEQ ID NO: 1215 - protein, 13 aa, Artificial Sequence
  TCR beta E6(29-38) CDR3 consensus
  VARIANT (4)...(4): X4 is L or R
  VARIANT (5)...(5): X5 is S or T
  VARIANT (6)...(6): X6 is G, T, or A
  VARIANT (7)...(7): X7 is T or null
  VARIANT (8)...(8): X8 is G or null
  VARIANT (11)...(11): X11 is G or null
ASSXXXXXNYXYT

SEQ ID NO: 1216 - protein, 13 aa, Artificial Sequence
  TCR beta E6(29-38) CDR3 consensus
  VARIANT (4)...(4): X4 is L, F, or P
  VARIANT (7)...(7): X7 is R or Q
  VARIANT (12)...(12): X12 is Q or L
ASSXWGXSNQPXH

SEQ ID NO: 1217 - protein, 14 aa, Artificial Sequence
  TCR beta E6(29-38) CDR3 consensus
  VARIANT (4)...(4): X4 is L or R
  VARIANT (5)...(5): X5 is W or Q
  VARIANT (6)...(6): X6 is G or P
  VARIANT (7)...(7): X7 is R or S
  VARIANT (8)...(8): X8 is S or null
ASSXXXXXSGNTIY

SEQ ID NO: 1218 - protein, 6 aa, Artificial Sequence
  TCR beta E6(29-38) CDR1 consensus
  VARIANT (1)...(1): X1 is S, M, D, or L
  VARIANT (2)...(2): X2 is G, E, D, N, Q, S, or F
  VARIANT (3)...(3): X3 is  H, V, Y, N, or Q
  VARIANT (4)...(4): X4 is A, S, F, or null
  VARIANT (5)...(5): X5 is W V, N, E, T, P, Y, K, D, or L
  VARIANT (6)...(6): X6 is S, R, A, N, Y, M, or T
XXXXXX

SEQ ID NO: 1219 - protein, 7 aa, Artificial Sequence
  TCR beta E6(29-38) CDR2 consensus
  VARIANT (1)...(1): X1 is F, Y, S, A or M
  VARIANT (2)...(2): X2 is N, Q, V, T, Y, or A
  VARIANT (3)...(3): X3 is N, D, E, S, G, I, F, Q, or L
  VARIANT (4)...(4): X4 is G, A, N, or null
  VARIANT (5)...(5): X5 is E, K, V, E, S, T, G, or N
  VARIANT (6)...(6): X6 is A, E, K, G, L, D, V, or N
  VARIANT (7)...(7): X7 is Q, M, T, A, V, E, P, D, or I
XXXXXXX

SEQ ID NO: 1220 - protein, 18 aa, Artificial Sequence
  TCR alpha E6(29-38) CDR3 consensus
  VARIANT (1)...(1): X1 is A, I, or V
  VARIANT (2)...(2): X2 is M, L, A, V, S, or E
  VARIANT (3)...(3): X3 is  R, L, N, S, Q, K, G, or W
  VARIANT (4)...(4): X4 is E, V, P, T, F, A, G, N, D, or L
  VARIANT (5)...(5): X5 is G, I, D, L, A, P, N, R, T, or null
  VARIANT (6)...(6): X6 is G, N, R, T, M, S, P, or null
  VARIANT (7)...(7): X7 is G, V, D, L, Q, T, R, or null
  VARIANT (8)...(8): X8 is T, D, S, L, G, or null
  VARIANT (9)...(9): X9 is A, G, Q, or null
  VARIANT (10)...(10): X10 is G or null
  VARIANT (11)...(11): X11 is G or null
  VARIANT (12)...(12): X12 is T or null
  VARIANT (13)...(13): X13 is S, A, T, G or null
  VARIANT (14)...(14): X14  is G, Y, T, N, A, W, or null
  VARIANT (15)...(15): X15  is F, G, N, T, Y, D, S, R, Q, or E
  VARIANT (16)...(16): X16 is K, P, A, D, or Q
  VARIANT (17)...(17): X17 is L, M, I, V, or T
  VARIANT (18)...(18): X18 is I, T, V, F, R, or Q
XXXXXXXXXXXXXXXXXX

SEQ ID NO: 1221 - protein, 11 aa, Artificial Sequence
  TCR alpha E6(296-38) CDR3 consensus
  VARIANT (2)...(2): X2 is V or M
  VARIANT (4)...(4): X4 is P or D
  VARIANT (6)...(6): X6 is N or R
AXRXAXNNDMR

SEQ ID NO: 1222 - protein, 15 aa, Artificial Sequence
  TCR alpha E6(29-38) CDR3 consensus
  VARIANT (1)...(1): X1 is A, S, or V
  VARIANT (2)...(2): X2 is S, A, or V
  VARIANT (3)...(3): X3 is  S, R, or Q
  VARIANT (4)...(4): X4 is H, P, Q, L, Y, G, T, F, S, R, or E
  VARIANT (5)...(5): X5 is L, G, R, W, F, S, V, T, Y, Q, or null
  VARIANT (6)...(6): X6 is A, G, L, E, P, or null
  VARIANT (7)...(7): X7 is G, T, A, R, Q, N, S, or null
  VARIANT (8)...(8): X8 is G, S, or null
  VARIANT (9)...(9): X9 is G or null
  VARIANT (10)...(10): X10 is F, G, A, S, T, R, Q, L, or null
  VARIANT (11)...(11): X11 is T, N, F, A, R, S, G, or null
  VARIANT (12)...(12): X12 is G, T, L D, Y, N, Q, S, or E
  VARIANT (13)...(13): X13 is E, W, T,G,  K, N, or P
  VARIANT (14)...(14): X14  is L, A, K, Q, Y, or I
  VARIANT (15)...(15): X15  is F, H, Y, T, or I
XXXXXXXXXXXXXXX

SEQ ID NO: 1223 - protein, 15 aa, Artificial Sequence
  TCR beta E6(29-38) CDR3 consensus
  VARIANT (1)...(1): X1 is A or S
  VARIANT (2)...(2): X2 is S or A
  VARIANT (4)...(4): X4 is L, Y, P, or S
  VARIANT (5)...(5): X5 is W, F, V, L, or Y
  VARIANT (6)...(6): X6 is G or A
  VARIANT (7)...(7): X7 is A, R, Q, S, or null
  VARIANT (8)...(8): X8 is G or null
  VARIANT (9)...(9): X9 is G or null
  VARIANT (10)...(10): X10 is S, T, R, or G
  VARIANT (11)...(11): X11 is T, A, R, S, or N
  VARIANT (12)...(12): X12 is D, Y, T, or G
  VARIANT (13)...(13): X13 is T or E
XXSXXXXXXXXXXQY

SEQ ID NO: 1224 - DNA, 450 bp, Homo sapiens
  TCR 31 - Beta Native
gacagtgatcctgatctggtaaagctcccatcctgccctgaccctgccatgggcaccaggctcctcttctgggtggccttctgtctcctgggggcagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagccgcttcctcggaagcacagatacgcagtattttggcccaggcacccggctgacagtgctc

SEQ ID NO: 1225 - DNA, 469 bp, Homo sapiens
  TCR 31 - Alpha Native
gagatttgcagctttctaggcaggagacaagacaatctgcatcttcacaggagggatggccatgctcctgggggcatcagtgctgattctgtggcttcagccagactgggtaaacagtcaacagaagaatgatgaccagcaagttaagcaaaattcaccatccctgagcgtccaggaaggaagaatttctattctgaactgtgactatactaacagcatgtttgattatttcctatggtacaaaaaataccctgctgaaggtcctacattcctgatatctataagttccattaaggataaaaatgaagatggaagattcactgtcttcttaaacaaaagtgccaagcacctctctctgcacattgtgccctcccagcctggagactctgcagtgtacttctgtgcagcaagcgaaagaggaacctacaaatacatctttggaacaggcaccaggctgaaggttttagca

SEQ ID NO: 1226 - DNA, 449 bp, Homo sapiens
  TCR 34  - Alpha Native
gggatagccctggccaactttcaaggctcctaaatctgagttttcagtgaactggacagaaaaaaaaaatgaagaagctactagcaatgattctgtggcttcaactagaccggttaagtggagagctgaaagtggaacaaaaccctctgttcctgagcatgcaggagggaaaaaactataccatctactgcaattattcaaccacttcagacagactgtattggtacaggcaggatcctgggaaaagtctggaatctctgtttgtgttgctatcaaatggagcagtgaagcaggagggacgattaatggcctcacttgataccaaagcccgtctcagcaccctccacatcacagctgccgtgcatgacctctctgccacctacttctgtgccgtgtcaggaacctacaaatacatctttggaacaggcaccaggctgaaggttttagca

SEQ ID NO: 1227 - DNA, 418 bp, Homo sapiens
  TCR 34 - Beta Native
gggctgcctgccccactgtgccatgggccctgggctcctctgctgggcgctgctttgtctcctgggagcaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcaggggaaacttccctcctagattctcaggtctccagttccctaattatagctctgagctgaatgtgaacgccttggagctggacgactcggccctgtatctctgtgccagcagctcgtatgccggaagctacgagcagtacttcgggccgggcaccaggctcacggtcaca

SEQ ID NO: 1228 - DNA, 432 bp, Homo sapiens
  TCR 55 - Beta Native
gattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcacaacgaggagctcctacgagcagtacttcgggccgggcaccaggctcacggtcacagaggacctgaaaaac

The invention claimed is:

1. An engineered T cell containing a heterologous TCR that binds to or recognizes a peptide epitope of human papillomavirus (HPV) 16 E7 in the context of a major histocompatibility complex (MHC) molecule, wherein:
   the T cell is a human T cell;
   the T cell contains a genetic disruption of a T cell receptor alpha constant (TRAC) gene and/or a T cell receptor beta constant (TRBC) gene; and
   the heterologous TCR comprises an alpha chain and a beta chain, wherein the Vα region of the alpha chain comprises a CDR-1, CDR-2, and CDR-3, comprising the amino acid sequences of SEQ ID NOs: 157, 158, and 159, respectively, and the Vβ region of the beta chain comprises a CDR-1, CDR-2, and CDR-3, comprising the amino acid sequences of SEQ ID NOs: 154, 155, and 160, respectively.

2. The engineered T cell of claim 1, wherein the TRBC gene is one or both of a T cell receptor beta constant 1 (TRBC1) or T cell receptor beta constant 2 (TRBC2) gene.

3. The engineered T cell of claim 1, wherein the genetic disruption of the TRAC gene reduces or prevents expression of the endogenous TCR constant alpha (Cα) chain in the T cell and/or the genetic disruption of the TRBC gene reduces or prevents expression of an endogenous TCR constant beta (Cβ) chain in the T cell.

4. The engineered T cell of claim 3, wherein the endogenous TCR Cα is encoded by the TRAC gene locus of SEQ ID NO: 348, or wherein the endogenous TCR Cβ is encoded by the TRBC1 gene locus of SEQ ID NO: 349, or wherein the endogenous TCR Cβ is encoded by the TRBC2 gene locus of SEQ ID NO: 1047.

5. The engineered T cell of claim 3, wherein the reduction or prevention of expression of the endogenous TCR in the T cell increases expression of the heterologous TCR or antigen binding fragment thereof by 1.5 fold, 2-fold, 3-fold, 4-fold, 5-fold or more.

6. The engineered T cell of claim 1, wherein the heterologous TCR binds to or recognizes a peptide epitope of human papillomavirus (HPV) 16 E7 in the context of an MHC molecule that is or contains the sequence set forth in SEQ ID NO:236.

7. A method for producing the T cell of claim 1 comprising:
   i) introducing a vector comprising a nucleic acid encoding a TCR into a human T cell in vitro or ex vivo, wherein the TCR binds to or recognizes a peptide epitope of human papillomavirus (HPV) 16 E7 in the context of a major histocompatibility complex (MEW) molecule and comprises an alpha chain and a beta chain, wherein:
   the Vα region of the alpha chain comprises a CDR-1, CDR-2, and CDR-3, comprising the amino acid sequences of SEQ ID NOs: 157, 158, and 159, respectively, and the Vβ region of the beta chain comprises a CDR-1, CDR-2, and CDR-3, comprising the amino acid sequences of SEQ ID NOs: 154, 155, and 160, respectively; and
   ii) introducing into the T cell one or more agents, wherein each of the one or more agents is independently capable of inducing a genetic disruption of the TRAC gene and/or the TRBC gene.

8. The method of claim 7, wherein the Vα region comprises the amino acid sequence set forth in SEQ ID NO: 119 or an amino acid sequence that has at least 90% sequence identity thereto, and the Vβ region comprises the amino acid sequence set forth in SEQ ID NO: 120, or an amino acid sequence that has at least 90% sequence identity thereto.

9. The method of claim 7, wherein the Vα and Vβ regions comprise the amino acid sequences of SEQ ID NOs: 119 and 120, respectively.

10. The method of claim 7, wherein the alpha constant (Cα) region of the alpha chain and the beta constant (Cβ) region of the beta chain are human or comprise one or more amino acid replacements thereof to introduce one or more cysteine residues that are capable of forming one or more non-native disulfide bridges between the alpha chain and beta chain.

11. The method of claim 7, wherein the alpha chain and beta chain comprise the amino acid sequences of SEQ ID NOs: 218 and 214, respectively.

12. The method of claim 7, wherein the alpha chain and beta chain comprise the amino acid sequences of SEQ ID NOs: 201 and 197, respectively.

13. The method of claim 7, wherein the TCR is encoded by a nucleotide sequence in which the encoded alpha chain and the encoded beta chain are separated by a peptide sequence that causes ribosome skipping.

14. The method of claim 13, wherein the peptide is a T2A or a P2A peptide.

15. A composition containing an engineered T cell of claim 1 and a pharmaceutically acceptable excipient.

16. A method of treatment, comprising administering the composition of claim 15 to a subject having a disease or disorder associated with HPV.

17. A composition of claim 15, wherein the composition comprises engineered CD8+ T cells and engineered CD4+ T cells.

18. The engineered T cell of claim 1, wherein the T cell contains a genetic disruption of a T cell receptor alpha constant (TRAC) gene, and wherein the genetic disruption of the TRAC gene reduces or prevents expression of the endogenous TCR constant alpha (Cα) chain in the T cell.

19. A composition comprising an engineered T cell of claim 18.

20. A composition of claim 19, wherein the composition comprises engineered CD8+ T cells and engineered CD4+ T cells.

21. A method of treatment, comprising administering the composition of claim 19 to a subject having a disease or disorder associated with HPV.

22. The engineered T cell of claim 18, wherein the endogenous TCR Cα is encoded by the TRAC gene locus of SEQ ID NO: 348.

23. The engineered T cell of claim 1, wherein the T cell contains a genetic disruption of a T cell receptor beta constant (TRBC) gene, and wherein the genetic disruption of the TRBC gene reduces or prevents expression of the endogenous TCR constant alpha (Cβ) chain in the cell.

24. A composition comprising an engineered T cell of claim 23.

25. A composition of claim 24, wherein the composition comprises engineered CD8+ T cells and engineered CD4+ T cells.

26. A method of treatment, comprising administering the composition of claim 24 to a subject having a disease or disorder associated with HPV.

27. The engineered T cell of claim 23, wherein the endogenous TCR Cβ is encoded by the TRBC1 gene locus of SEQ ID NO: 349 or wherein the endogenous TCR Cβ is encoded by the TRBC2 gene locus of SEQ ID NO: 1047.

28. The engineered T cell of claim 1, wherein the Vα region comprises the amino acid sequence set forth in SEQ ID NO: 119 or an amino acid sequence that has at least 90% sequence identity thereto, and the Vβ region comprises the amino acid sequence set forth in SEQ ID NO: 120, or an amino acid sequence that has at least 90% sequence identity thereto.

29. The engineered T cell of claim 1, wherein the Vα and Vβ regions comprise the amino acid sequences of SEQ ID NOs: 119 and 120, respectively.

30. The engineered T cell of claim 1, wherein the alpha constant (Cα) region of the alpha chain and the beta constant (Cβ) region of the beta chain are human or comprise one or more amino acid replacements thereof to introduce one or more cysteine residues that are capable of forming one or more non-native disulfide bridges between the alpha chain and beta chain.

31. The engineered T cell of claim 1, wherein the alpha chain and beta chain comprise the amino acid sequences of SEQ ID NOs: 218 and 214, respectively.

32. The engineered T cell of claim 1, wherein the alpha chain and beta chain comprise the amino acid sequences of SEQ ID NOs: 201 and 197, respectively.

33. The engineered T cell of claim 1, wherein the heterologous TCR is encoded by a nucleotide sequence in which the encoded alpha chain and the encoded beta chain are separated by a peptide sequence that causes ribosome skipping.

34. The engineered T cell of claim 33, wherein the peptide is a T2A or a P2A peptide.

* * * * *